US010017543B2

(12) United States Patent
Kwong et al.

(10) Patent No.: US 10,017,543 B2
(45) Date of Patent: *Jul. 10, 2018

(54) PREFUSION RSV F PROTEINS AND THEIR USE

(71) Applicant: The United States of America, as represented by the Secretary, Department of Health and Huamn Services, Washington, DC (US)

(72) Inventors: Peter D. Kwong, Washington, DC (US); Barney S. Graham, Rockville, MD (US); Jason S. McLellan, Norwich, VT (US); Jeffrey Boyington, Clarksburg, MD (US); Lei Chen, Rockville, MD (US); Man Chen, Bethesda, MD (US); Gwo-Yu Chuang, Rockville, MD (US); Ivelin Stefanov Georgiev, Gaithersburg, MD (US); Jason Gorman, Washington, DC (US); Michael Gordon Joyce, Washington, DC (US); Masaru Kanekiyo, Chevy Chase, MD (US); Gilad Ofek, Gaithersburg, MD (US); Marie Pancera, McLean, VA (US); Mallika Sastry, Rockville, MD (US); Cinque Soto, Rockville, MD (US); Sanjay Srivatsan, Lilburn, GA (US); Guillaume Stewart-Jones, Bethesda, MD (US); Yongping Yang, Potomac, MD (US); Baoshan Zhang, Bethesda, MD (US); Tongqing Zhou, Boyds, MD (US)

(73) Assignee: The United States of America, as represented by the Secretary, Department of Health and Human Services, Washington, DC (US)

(*) Notice: Subject to any disclaimer, the term of this patent is extended or adjusted under 35 U.S.C. 154(b) by 96 days.

This patent is subject to a terminal disclaimer.

(21) Appl. No.: 14/776,651

(22) PCT Filed: Mar. 13, 2014

(86) PCT No.: PCT/US2014/026714
§ 371 (c)(1),
(2) Date: Sep. 14, 2015

(87) PCT Pub. No.: WO2014/160463
PCT Pub. Date: Oct. 2, 2014

(65) Prior Publication Data
US 2016/0046675 A1 Feb. 18, 2016

Related U.S. Application Data

(60) Provisional application No. 61/863,909, filed on Aug. 9, 2013, provisional application No. 61/857,613, filed
(Continued)

(51) Int. Cl.
A61K 39/155 (2006.01)
C07K 14/005 (2006.01)
(Continued)

(52) U.S. Cl.
CPC ............ C07K 14/005 (2013.01); A61K 39/12 (2013.01); A61K 39/155 (2013.01); C12N 7/00 (2013.01); G01N 33/564 (2013.01); A61K 2039/5252 (2013.01); A61K 2039/5254 (2013.01); A61K 2039/53 (2013.01); A61K 2039/543 (2013.01); A61K 2039/55505 (2013.01); A61K 2039/55561 (2013.01); A61K 2039/55566 (2013.01); C07K 2319/21 (2013.01); C07K 2319/22 (2013.01); C07K 2319/50 (2013.01); C07K 2319/70 (2013.01); C07K 2319/735 (2013.01);
(Continued)

(58) Field of Classification Search
None
See application file for complete search history.

(56) References Cited

U.S. PATENT DOCUMENTS

2010/0068217 A1 3/2010 Kwong et al.
2010/0239593 A1 9/2010 Spits et al.
(Continued)

FOREIGN PATENT DOCUMENTS

CN 102210860 A 10/2011
WO WO 1998/02457 1/1998
(Continued)

OTHER PUBLICATIONS

Weisshaar et al. DNA and Cell Biology 2015, vol. 34, pp. 505-510.*
Murphy et al. Virus Research 1994 vol. 32, pp. 13-26.*
Arbiza, et al. "Characterization of two antigenic sites recognized by neutralizing monoclonal antibodies directed against the fusion glycoprotein of human respiratory syncytial virus." *The Journal of general virology*, 73 (1992): 2225-2234.
Beeler, et al. "Neutralization epitopes of the F glycoprotein of respiratory syncytial virus: effect of mutation upon fusion function." *Journal of virology*, 63.7 (1989): 2941-2950.
Bem et al. "Animal models of human respiratory syncytial virus disease." *American Journal of Physiology-Lung Cellular and Molecular Physiology*, 301.2 (2011): L148-L156.
(Continued)

Primary Examiner — Shanon A. Foley
Assistant Examiner — Myron G Hill
(74) Attorney, Agent, or Firm — Klarquist Sparkman, LLP

(57) ABSTRACT

Disclosed are Respiratory Syncytial Virus (RSV) antigens including a recombinant RSV F protein stabilized in a prefusion conformation. Also disclosed are nucleic acids encoding the antigens and methods of producing the antigens. Methods for generating an immune response in a subject are also disclosed. In some embodiments, the method is a method for treating or preventing a RSV infection in a subject by administering a therapeutically effective amount of the antigen to the subject.

58 Claims, 98 Drawing Sheets

Related U.S. Application Data on Jul. 23, 2013, provisional application No. 61/798,389, filed on Mar. 15, 2013, provisional application No. 61/780,910, filed on Mar. 13, 2013.

(51) Int. Cl.

| A61K 39/12 | (2006.01) |
|---|---|
| C12N 7/00 | (2006.01) |
| G01N 33/564 | (2006.01) |
| A61K 39/00 | (2006.01) |

(52) U.S. Cl.
CPC .............. *C12N 2710/10343* (2013.01); *C12N 2760/18522* (2013.01); *C12N 2760/18534* (2013.01)

(56) References Cited

U.S. PATENT DOCUMENTS

| 2012/0070446 A1 | 3/2012 | Beaumont et al. |
| 2012/0093847 A1 | 4/2012 | Baudoux et al. |
| 2012/0164176 A1 | 6/2012 | Swanson et al. |
| 2012/0315270 A1 | 12/2012 | McLellan et al. |
| 2014/0072575 A1 | 3/2014 | Spits et al. |
| 2014/0248314 A1* | 9/2014 | Swanson .............. A61K 39/155 424/211.1 |
| 2014/0271699 A1 | 9/2014 | Kwong et al. |
| 2016/0046675 A1* | 2/2016 | Kwong .................. A61K 39/12 424/186.1 |

FOREIGN PATENT DOCUMENTS

| WO | WO 2005/111621 | 11/2005 |
| WO | WO 2006/091455 | 8/2006 |
| WO | WO 2009/079796 | 7/2009 |
| WO | WO 2010/149743 | 12/2010 |
| WO | WO 2010/149745 | 12/2010 |
| WO | WO 2011/008974 | 1/2011 |
| WO | WO 2011/043643 | 4/2011 |
| WO | WO 2012/158613 | 11/2012 |
| WO | WO2012/158613 | * 11/2012 |
| WO | WO 2013/017713 | 2/2013 |
| WO | WO 2014/024026 | 2/2014 |
| WO | WO 2014/079842 | 5/2014 |
| WO | WO 2014/139476 | 9/2014 |
| WO | WO 2014/174018 | 10/2014 |

OTHER PUBLICATIONS

Bian, et al., "Influenza virus vaccine expressing fusion and attachment protein epitopes of respiratory syncytial virus induces protective antibodies in BALB/c mice," *Antiviral Research*, 104: 110-117, 2014 (published online, Feb. 6, 2014).

Blanco, et al., "A recombinant anchorless respiratory syncytial virus (RSV) fusion (F) protein/monophosphoryl lipid A (MPL) vaccine protects against RSV-induced replication and lung pathology," *Vaccine*, 32(13): 1495-1500, 2014 (published online, Nov. 16, 2013).

Chaiwatpongsakorn, et al. "Soluble respiratory syncytial virus fusion protein in the fully cleaved, pretriggered state is trsaiggered by exposure to low-molarity buffer," *Journal of virology* 85.8 (2011): 3968-3977.

Chambers, et al., "Sequence analysis of the gene encoding the fusion glycoprotein of pneumonia virus of mice suggests possible conserved secondary structure elements in paramyxovirus fusion glycoproteins." *The Journal of general virology* 73 (1992): 1717-1724.

Cherukuri, et al., "An adjuvanted respiratory syncytial virus fusion protein induces protection in aged BALB/c mice," *Immun Ageing*, 9(1): 21, 2012.

Collarini, et al., "Potent high-affinity antibodies for treatment and prophylaxis of respiratory syncytial virus derived from B cells of infected patients." *The Journal of Immunology*, 183.10 (2009): 6338-6345.

Collins, et al., "Respiratory syncytial virus: virology, reverse genetics, and pathogenesis of disease," *Current topics in microbiology and immunology*, 372: 3-38, Dec. 21, 2013.

Colman, et al. "The structural biology of type I viral membrane fusion." *Nature Reviews Molecular Cell Biology*, 4.4 (2003): 309-319.

Connor, et al. "Comparison of human respiratory syncytial virus A2 and 8/60 fusion glycoprotein gene sequences and mapping of sub-group specific antibody epitopes." *Journal of medical virology* 63.2 (2001): 168-177.

Correia, et al., "Proof of principle for epitope-focused vaccine design," *Nature*, 507 (7491): 201-206, 2014, (published online, Feb. 5, 2014).

Corvaisier, et al. "Cross-reactive and group-specific immune responses to a neutralizing epitope of the human respiratory syncytial virus fusion protein," *Archives of virology*, 142.6 (1997): 1073-1086.

Crim, et al. "Identification of linear heparin-binding peptides derived from human respiratory syncytial virus fusion glycoprotein that inhibit infectivity." *Journal of virology*, 81.1 (2007): 261-271.

Cseke, et al. "Integrin $\alpha v\beta 1$ promotes infection by human metapneumovirus." *Proceedings of the National Academy of Sciences*, 106.5 (2009): 566-1571.

Dombkowski, "Disulfide by Design™: a computational method for the rational design of disulfide bonds in proteins." *Bioinformatics*, 19.14 (2003): 1852-1853.

Ekiert, et al. "Cross-neutralization of influenza A viruses mediated by a single antibody loop." *Nature*, 489.7417 (2012): 526-532.

Eyles, et al., "Nonreplicating vaccines can protect african green monkeys from the memphis 37 strain of respiratory syncytial virus," *Journal of Infectious Diseases*, 208 (2): 319-329, 2013 (published online, Apr. 17, 2013).

Feldman, et al. "The fusion glycoprotein of human respiratory syncytial virus facilitates virus attachment and infectivity via an interaction with cellular heparan sulfate." *Journal of virology*, 74.14 (2000): 6442-6447.

Frank, et al. "Stabilization of short collagen-like triple helices by protein engineering." *Journal of molecular biology*, 308.5 (2001): 1081-1089.

Gilman, et al., "Characterization of a Prefusion-Specific Antibody That Recognizes a Quaternary, Cleavage-Dependent Epitope on the RSV Fusion Glycoprotein," *PLoS Pathog*, 11(7): e1005035, 2015.

Graham, et al., "Challenges and opportunities for respiratory syncytial virus vaccines," *Current topics in microbiology and immunology*, 372: 391-404, Dec. 21, 2013.

Graham, et al., "Novel antigens for RSV vaccines," *Current Opinion in Immunology*, 35: 30-38, 2015.

Graham. "Biological challenges and technological opportunities for respiratory syncytial virus vaccine development." *Immunological reviews*, 239.1 (2011): 149-166.

Hall, el al. "The burden of respiratory syncytial virus infection in young children." *New England Journal of Medicine*, 360,6 (2009): 588-598.

Harbury, et al. "A switch between two-, three-, and four-stranded coiled coils in GCN4 leucine zipper mutants." *Science* 262.5138 (1993): 1401-1407.

Hoppe, et al. "A parallel three stranded $\alpha$-helical bundle at the nucleation site of collagen triple-helix formation." *FEBS letters* 344.2 (1994): 191-195.

IMpact-RSV Study Group. "Palivizumab, a humanized respiratory syncytial virus monoclonal antibody, reduces hospitalization from respiratory syncytial virus infection in high-risk infants." *Pediatrics*, 102.3 (1998): 531-537.

International Preliminary Report on Patentability for App. No. PCT/CN2014/073505, mailed by the State Intellectual Property Office of the P.R. China as ISA dated Jun. 16, 2014 (43 pages, with English translation).

International Search Report for App. No. PCT/CN2014/073505, mailed by the State Intellectual Property Office of the P.R. China as ISA dated Jun. 16, 2014 (4 pages, with English translation).

(56) References Cited

OTHER PUBLICATIONS

Izard, et al. "Principles of quasi-equivalence and Euclidean geometry govern the assembly of cubic and dodecahedral cores of pyruvate dehydrogenase complexes," *Proceedings of the National Academy of Sciences*, 96.4 (1999): 1240-1245.
Johnson, et al. "Development of a humanized monoclonal antibody (MEDI-493) with potent in vitro and in vivo activity against respiratory syncytial virus." *Journal of Infectious Diseases*, 176.5 (1997): 1215-1224.
Johnson, et al., "Genetic vaccine for respiratory syncytial virus provides protection without disease potentiation," *Molecular Therapy*, 22 (1): 196-205, 2014 (published online, Jun. 10, 2013).
Jones, et al., "Sendai virus-based RSV vaccine protects African green monkeys from RSV infection," *Vaccine*, 30 (5): 959-968, 2012.
Kanekiyo, et al. "Self-assembling influenza nanoparticle vaccines elicit broadly neutralizing H1N1 antibodies." *Nature* 499, No. 7456: 102-106 (2013).
Kim, et al., "Development of an adenovirus-based respiratory syncytial virus vaccine: preclinical evaluation of efficacy, immunogenicity, and enhanced disease in a cotton rat model," *Journal of Virology*, 88 (9): 5100-5108, 2014 (published online, Feb. 26, 2014).
Kwakkenbos, et al. "Generation of stable monoclonal antibody-producing B cell receptor-positive human memory B cells by genetic programming," *Nature medicine* 16.1 (2010): 123-128.
Lee, et al. "Structure of the Ebola virus glycoprotein bound to an antibody from a human survivor." *Nature*, 454.7201 (2008): 177-182.
Liang, et al., "Chimeric bovine/human parainfluenza virus type 3 expressing respiratory syncytial virus (RSV) F glycoprotein: effect of insert position on expression, replication, immunogenicity, stability, and protection against RSV infection," *Journal of Virology*, 88 (8): 4237-4250, 2014 (published online, Jan. 29, 2014).
Liang, et al., "Enhanced Neutralizing Antibody Response Induced by Respiratory Syncytial Virus Pre-fusion F Protein Expressed by a Vaccine Candidate," *Journal of Virology*, JVI-01373-15, 2015 (published online, Jul. 8, 2015).
Lopez, et al. "Antigenic structure of human respiratory syncytial virus fusion glycoprotein." *Journal of virology*, 72.8 (1998): 6922-6928.
López, et al. "Location of a highly conserved neutralizing epitope in the F glycoprotein of human respiratory syncytial virus." *Journal of virology* 64.2 (1990): 927-930.
Lozano, et al. "Global and regional mortality from 235 causes of death for 20 age groups in 1990 and 2010: a systematic analysis for the Global Burden of Disease Study 2010." *The Lancet*, 380.9859 (2013): 2095-2128.
Ludwig, et al., "Electron cryomicroscopy reveals different F1+F2 protein states in intact parainfluenza virions," *Journal of Virology*, 82(7): 3775-3781, 2008.
Magro, et al. "Neutralization of human respiratory syncytial virus infectivity by antibodies and low-molecular-weight compounds targeted against the fusion glycoprotein." *Journal of virology*, 84.16 (2010): 7970-7982.
Magro, et al. "Neutralizing antibodies against the preactive form of respiratory syncytial virus fusion protein offer unique possibilities for clinical intervention." *Proceedings of the National Academy of Sciences* 109.8 (2012): 3089-3094.
Martin, el al. "Sequence elements of the fusion peptide of human respiratory syncytial virus fusion protein required for activity." *Journal of general virology*, 87.6 (2006): 1649-1658.
McAlinden, et al. "α-Helical coiled-coil oligomerization domains are almost ubiquitous in the collagen superfamily." *Journal of Biological Chemistry*, 278.43 (2003): 42200-42207.
McGinnes Cullen, et al., "Murine Immune Responses to Virus-like Particle Associated Pre-and Post-Fusion Forms of the Respiratory Syncytial Virus F Protein," *Journal of Virology*, 89(13):6835-6847, 2015.

McLellan et al., "Structure and function of respiratory syncytial virus surface glycoproteins," *Current topics in microbiology and immunology*, 372: 83-104, Dec. 21, 2013.
McLellan, "Neutralizing epitopes on the respiratory syncytial virus fusion glycoprotein," *Current Opinion in Virology*, 11: 70-75, 2015.
McLellan, et al. "Design and characterization of epitope-scaffold immunogens that present the motavizumab epitope from respiratory syncytial virus." *Journal of molecular biology* 409.5 (2011): 853-866.
McLellan, et al. "Structural basis of respiratory syncytial virus neutralization by motavizumab." *Nature structural & molecular biology* 17.2 (2010): 248-250.
McLellan, et al. "Structure of a major antigenic site on the respiratory syncytial virus fusion glycoprotein in complex with neutralizing antibody 101F." *Journal of virology* 84.23 (2010): 12236-12244.
McLellan, et al. "Structure of HIV-1 gp120 V1/V2 domain with broadly neutralizing antibody PG9." *Nature*, 480.7377 (2011): 336-343.
McLellan, et al. "Structure of respiratory syncytial virus fusion glycoprotein in the postfusion conformation reveals preservation of neutralizing epitopes." *Journal of virology* 85.15 (2011): 7788-7796.
McLellan, et al. "Structure of RSV fusion glycoprotein trimer bound to a prefusion-specific neutralizing antibody." *Science* vol. 340 (2013): pp. 1113-1117.
McLellan, el al. "Structure-based design of a fusion glycoprotein vaccine for respiratory syncytial virus." *Science* 342.6158 (2013): 592-598.
Miroshnikov, et al. "Engineering trimeric fibrous proteins based on bacteriophage T4 adhesins." *Protein engineering*, 11.4 (1998): 329-332.
Nair, et al. "Global burden of acute lower respiratory infections due to respiratory syncytial virus in young children: a systematic review and meta-analysis." *The Lancet*, 375.9725 (2010): 1545-1555.
Nelson, et al., "Genetic stability of RSV-F expression and the restricted growth phenotype of a live attenuated PIV3 vectored RSV vaccine candidate (MEDI-534) following restrictive growth in human lung cells," *Vaccine*, 31 (36): 3756-3762, 2013 (published online, Apr. 24, 2013).
Pancera, et al. "N332-Directed broadly neutralizing antibodies use diverse modes of HIV-1 recognition: inferences from heavy-light chain complementation of function." *PloS one*, 8.2 (2013): e55701.
Petersen, et al. "Amino acid neighbours and detailed conformational analysis of cysteines in proteins." *Protein engineering*, 12.7 (1999): 535-548.
Shay, et al. "Bronchiolitis-associated hospitalizations among US children, 1980-1996." *JAMA*, 282.15 (1999): 1440-1446.
Stewart-Jones, et al. "A Cysteine Zipper Stabilizes a Pre-Fusion F Glycoprotein Vaccine for Respiratory Syncytial Virus," *PloS One*, 10(6): e0128779, 2015.
Sutter, et al. "Structural basis of enzyme encapsulation into a bacterial nanocompartment." *Nature structural & molecular biology*, 15.9 (2008): 939-947.
Swanson, et al. "Structural basis for immunization with postfusion respiratory syncytial virus fusion F glycoprotein (RSV F) to elicit high neutralizing antibody titers." *Proceedings of the National Academy of Sciences* 108.23 (2011): 9619-9624.
Swanson, et al., "A monomeric uncleaved respiratory syncytial virus f antigen retains prefusion-specific neutralizing epitopes," *Journal of Virology*, 88(20): 11802-11810, 2014 (published online, Jul. 30, 2014).
Urich, et al. "X-ray structure of a self-compartmentalizing sulfur cycle metalloenzyme." *Science*, 311.5763 (2006): 996-1000.
Walsh, et al. "Monoclonal antibodies to respiratory syncytial virus proteins: identification of the fusion protein." *Journal of Virology*, 47.1 (1983): 171-177.
Welch, et al. "Structure of the cleavage-activated prefusion form of the parainfluenza virus 5 fusion protein." *Proceedings of the National Academy of Sciences*, 109.41 (2012): 16672-16677.
Wen, et al. "Structure of the human metapneumovirus fusion protein with neutralizing antibody identifies a pneurnovirus antigenic site." *Nature structural & molecular biology*, 19.4 (2012): 461-463.

(56) References Cited

OTHER PUBLICATIONS

Written Opinion of the ISA for App. No. PCT/CN2014/073505, mailed by the State Intellectual Property Office of the P.R. China as ISA dated Jun. 16, 2014 (8 pages, with English translation).

Wu, el al. "Development of motavizumab, an ultra-potent antibody for the prevention of respiratory syncytial virus infection in the upper and lower respiratory tract." *Journal of molecular biology*, 368.3 (2007): 652-665.

Yin, et al, "Structure of the parainfluenza virus 5 F protein in its metastable, prefusion conformation." *Nature*, 439.7072 (2006): 38-44.

Zhang, et al. "Self-assembly in the ferritin nano-cage protein superfamily." *International journal of molecular sciences* 12.8 (2011): 5406-5421.

Zhang, et al. "X-ray structure analysis and crystallographic refinement of lumazine synthase from the hyperthermophile Aquifex aeolicus at 1.6 Å resolution: determinants of thermostability revealed from structural comparisons." *Journal of molecular biology*, 306.5 (2001): 1099-1114.

\* cited by examiner

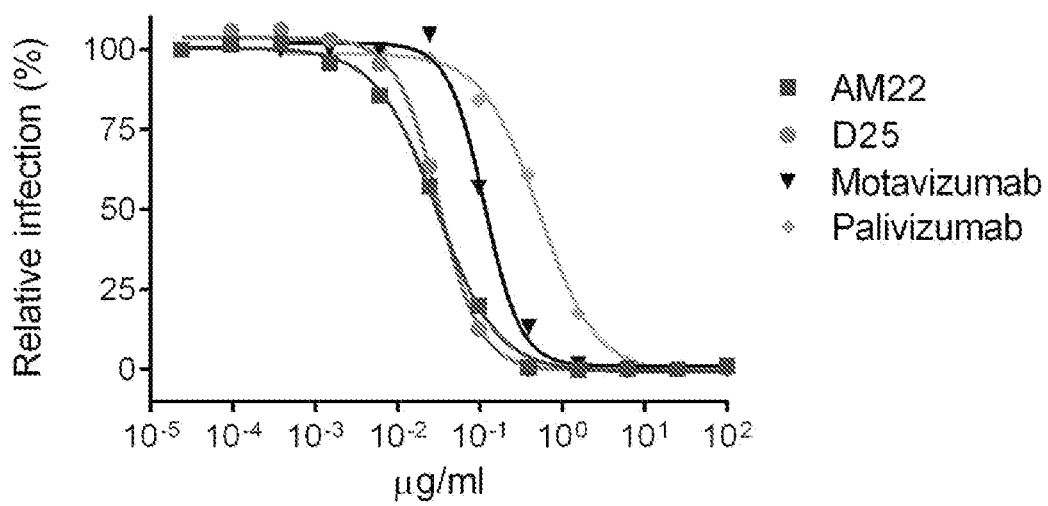
FIG. 1A RSV neutralization
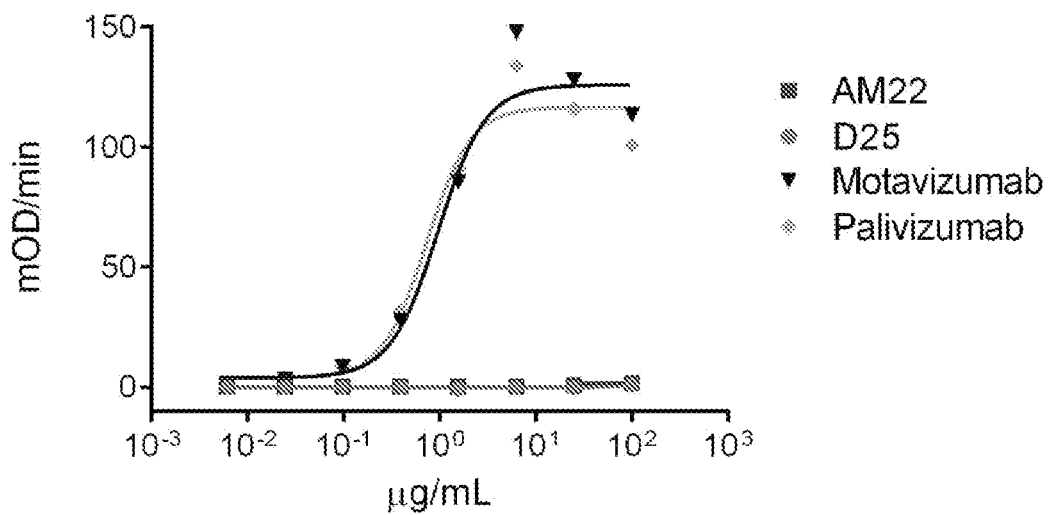
FIG. 1B Binding to postfusion RSV F

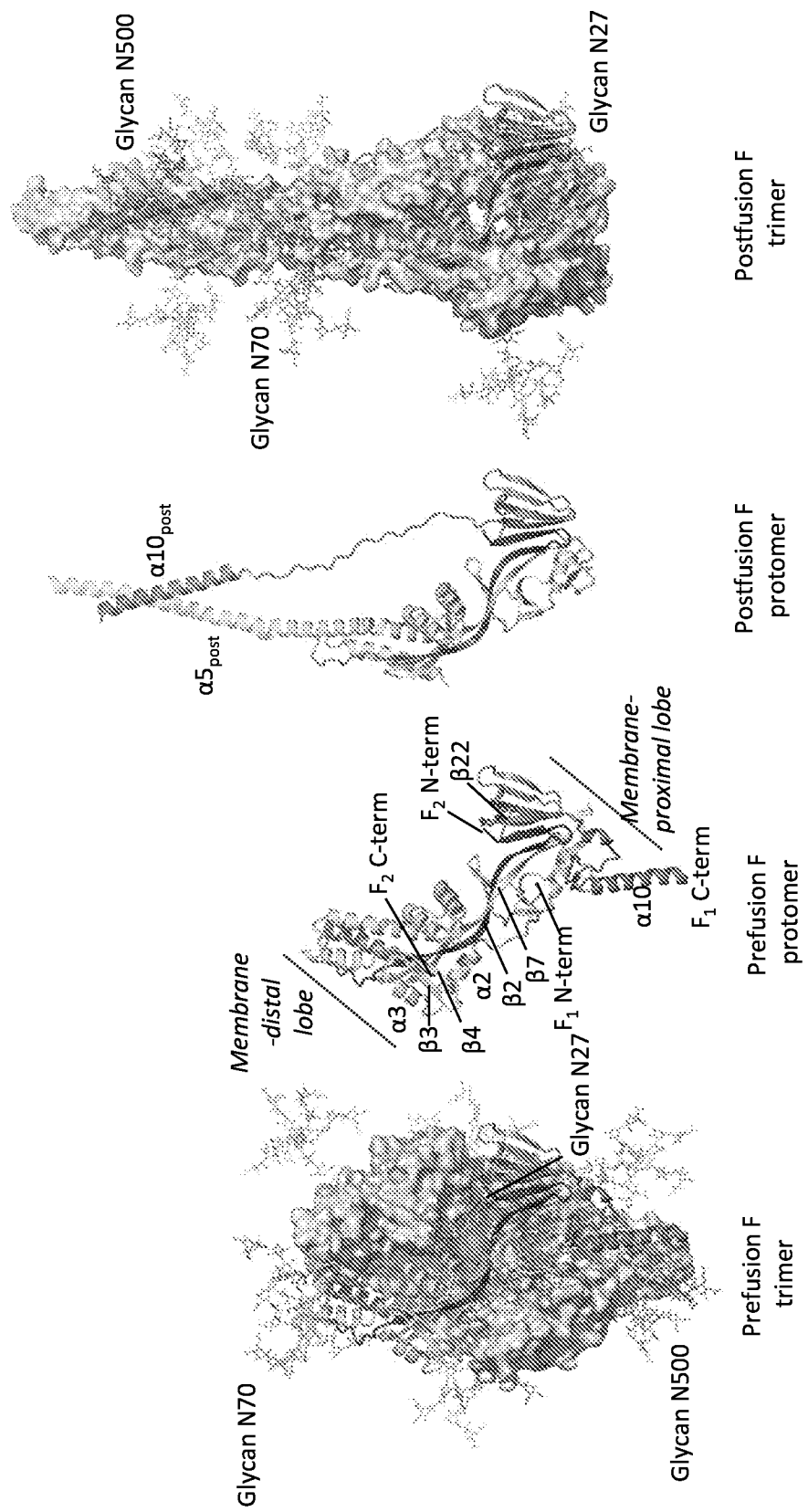

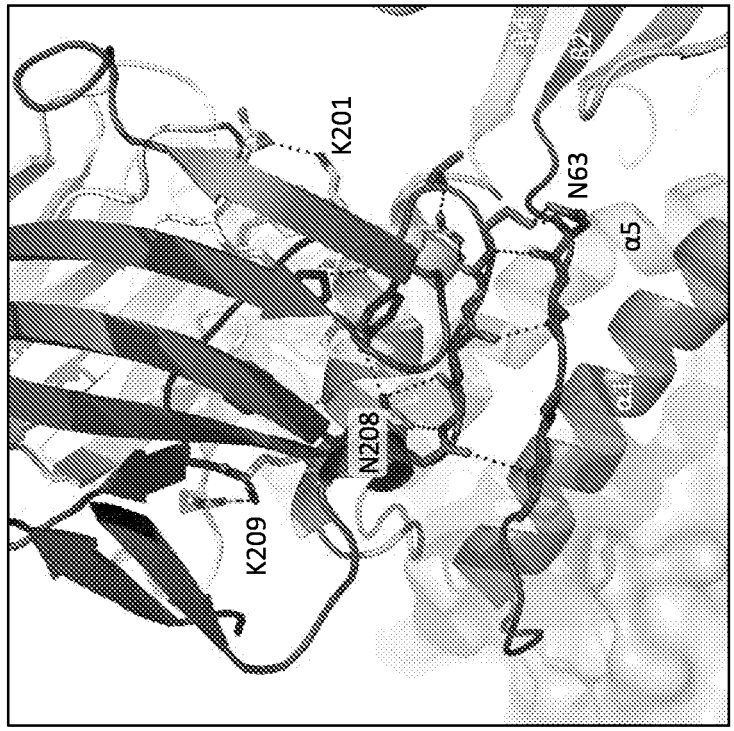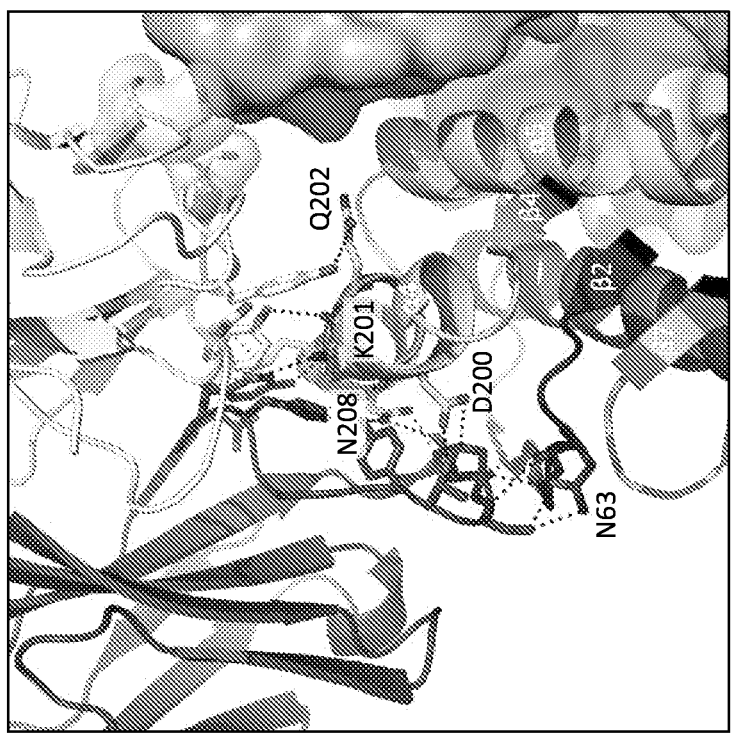
FIG. 3A

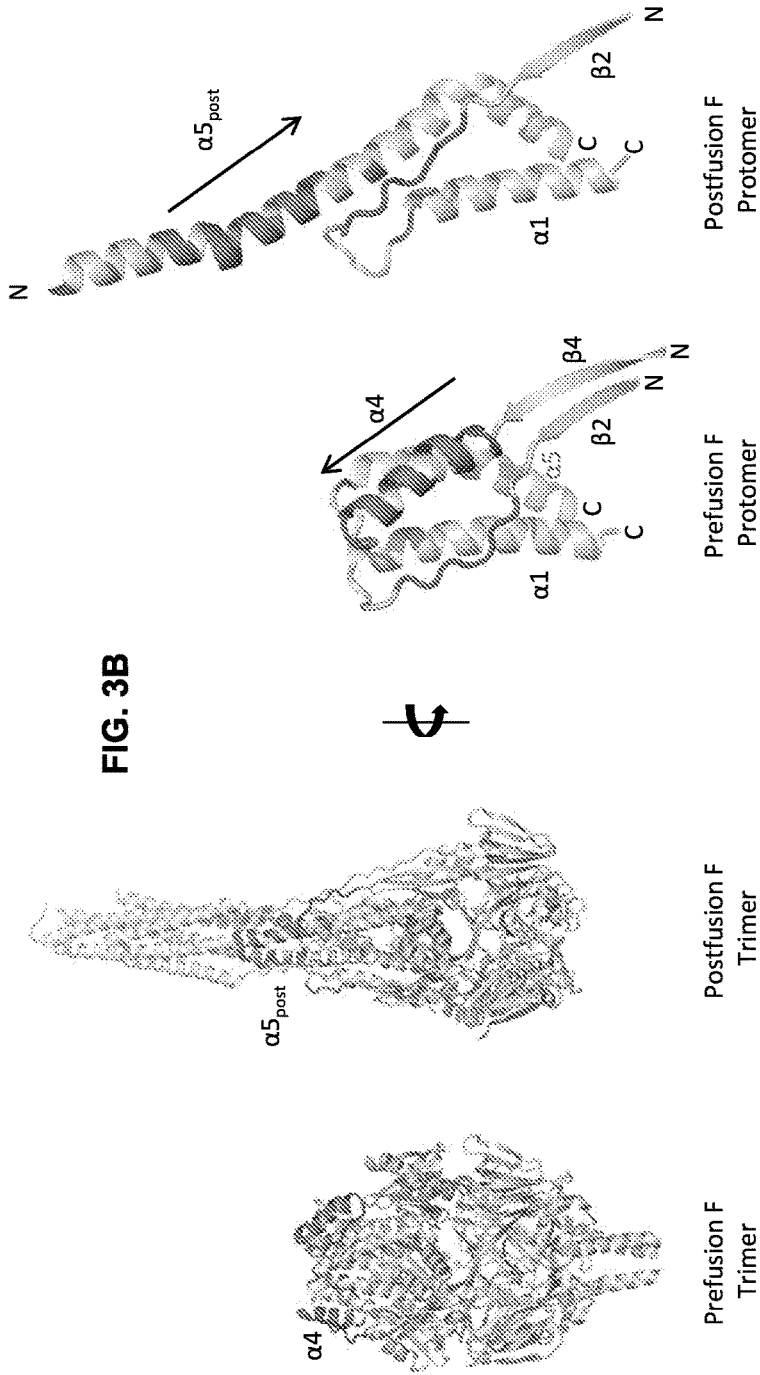

Fusion inhibition

Attachment inhibition

Ebola GP | Flu HA | PIV5 F | RSV F

Side / Top

FIG. 8
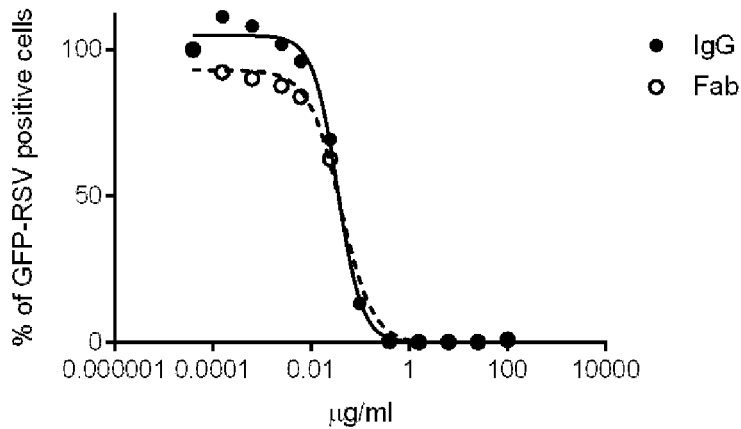
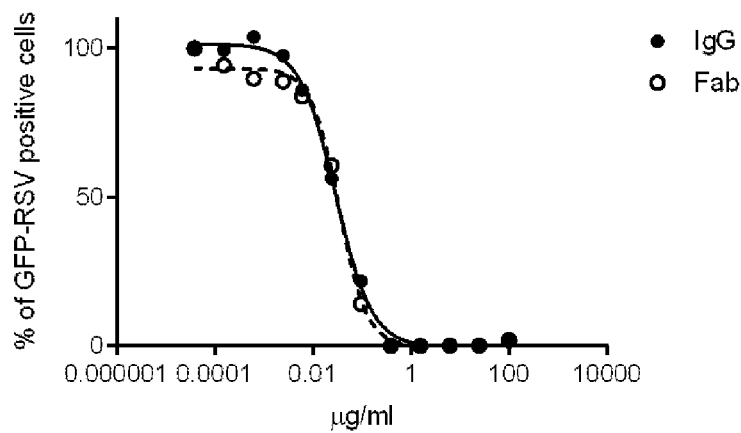
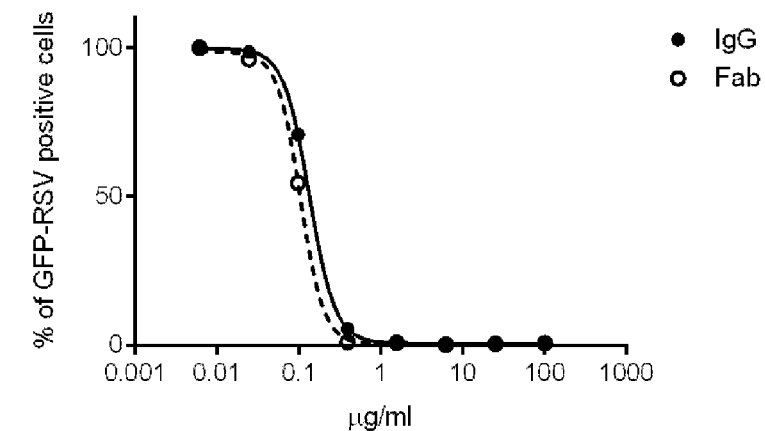

FIG. 9A
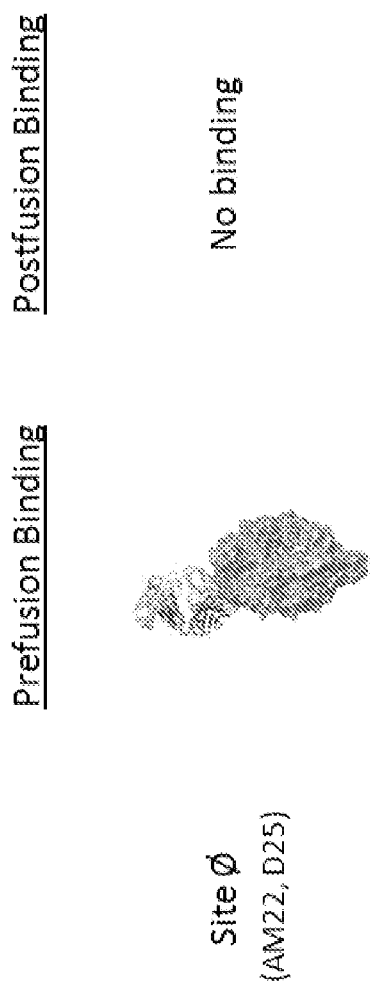
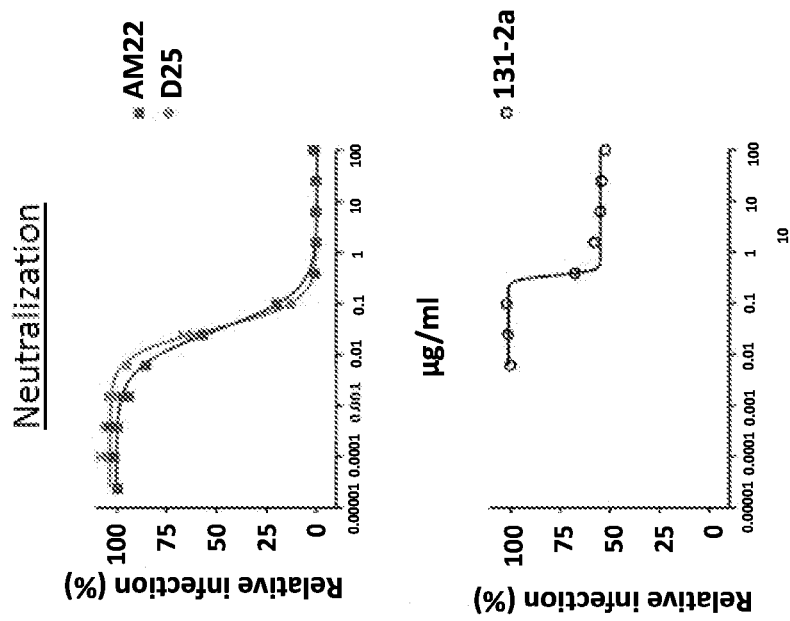

Mutation Ser155Cys/Ser290Cys Can Form a Disulfide Bond Only in Prefusion State

FIG. 11

Ser155Cys/Ser290Cys Stabilizes Prefusion Conformation of RSV F

FIG. 14 Neutralization of RSV subtypes A and B week 7

FIG. 15
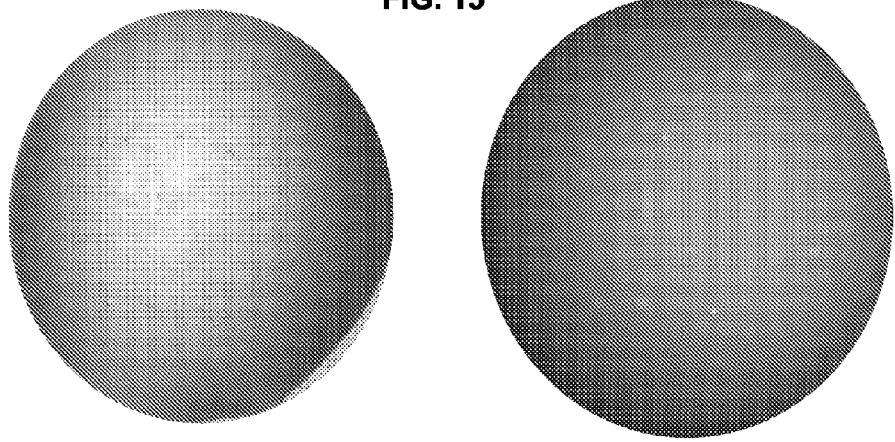
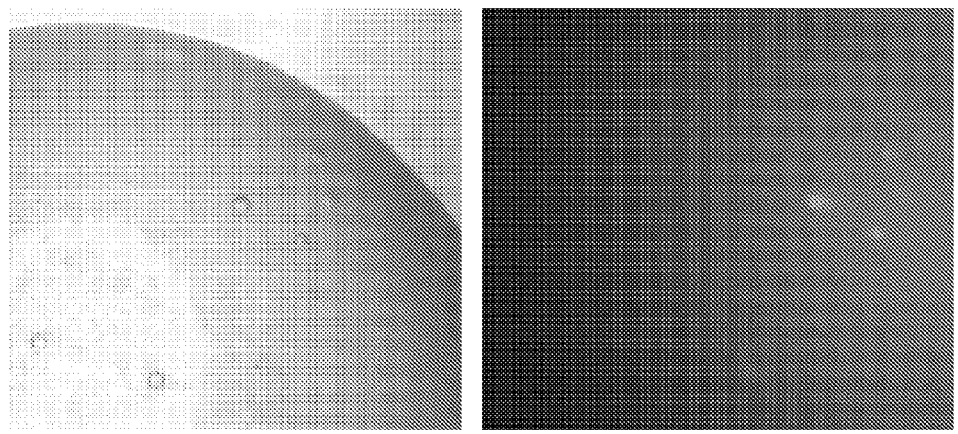

FIG. 17
D25 Kd= 0.2 nM
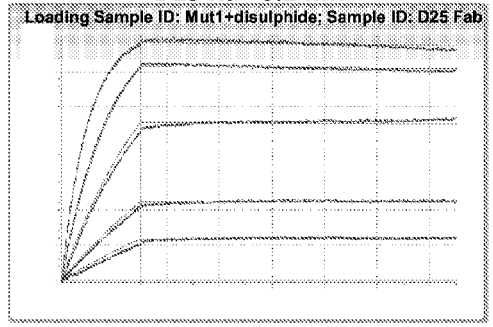
AM22 Kd< 0.01 nM
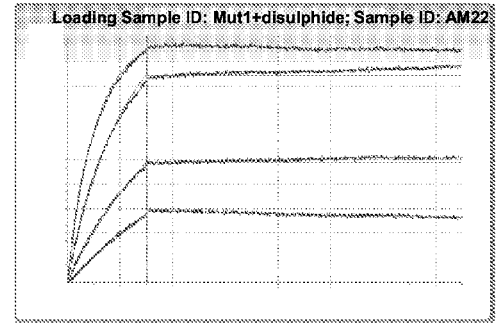
5C4 Kd= 13.2 nM
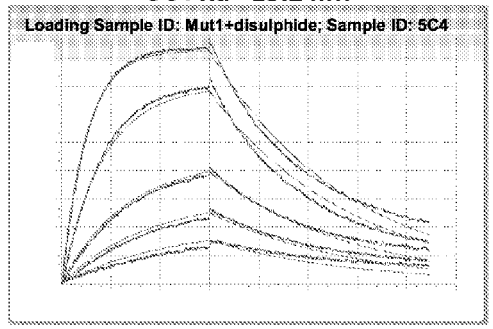
101F Kd= 3.2 nM
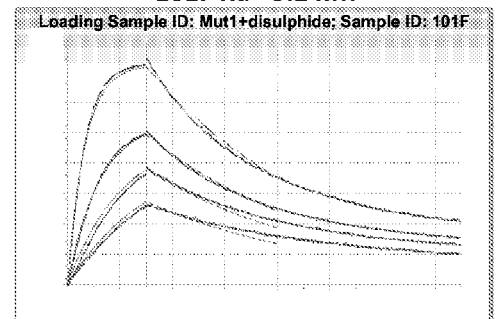
Motavizumab Kd= 0.04 nM
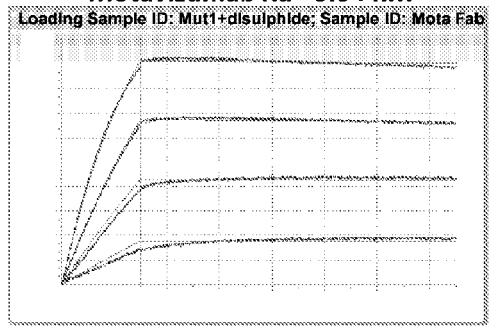
Palivizumab Kd= 23.4 nM
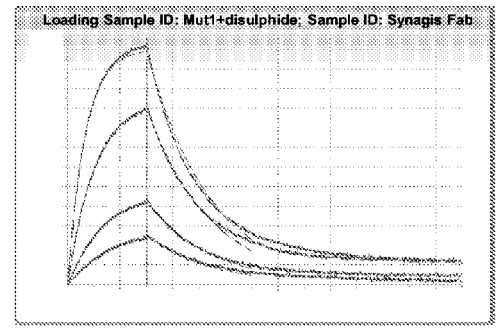

| RSV F variant | Yield (mg/L)* | Antibody K_D value (nM) | | | | | | Physical charac

FIG. 21
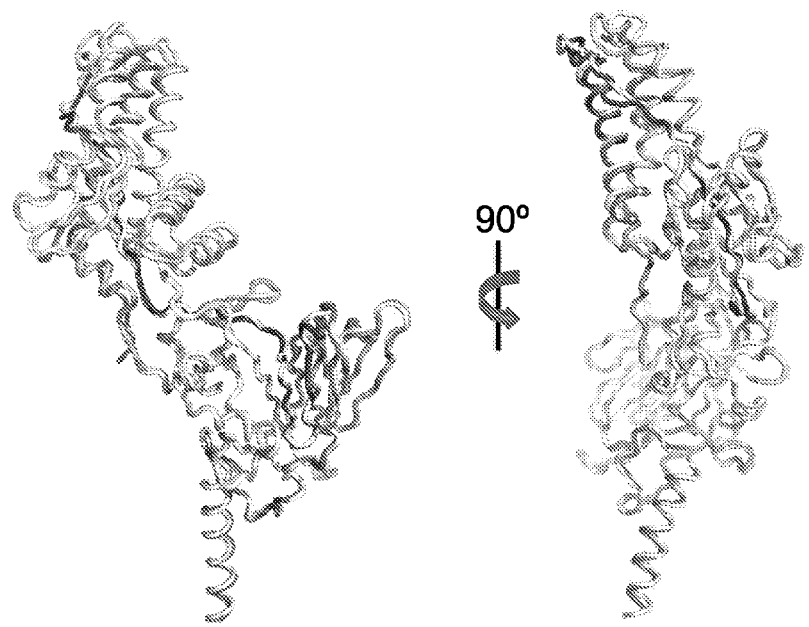
FIG. 22
Cys155-Cys290
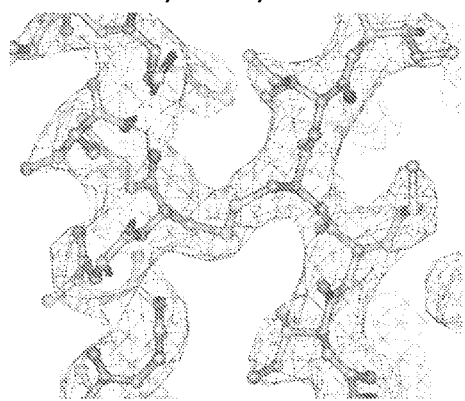
Phe190
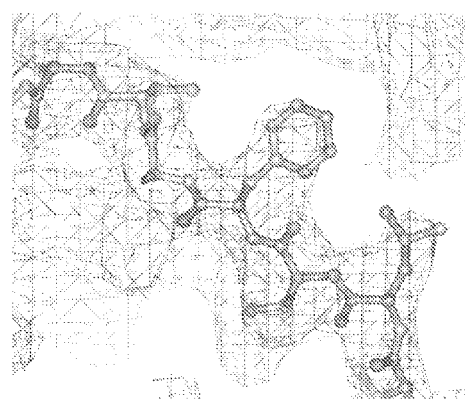

FIG. 26A
Characterization of protective responses
elicited by natural infection
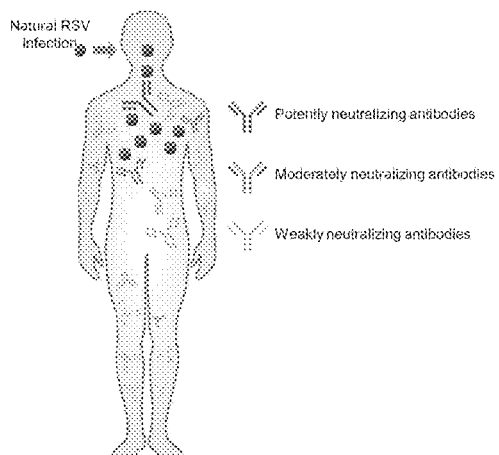
Information matrix for structure-based
vaccine design
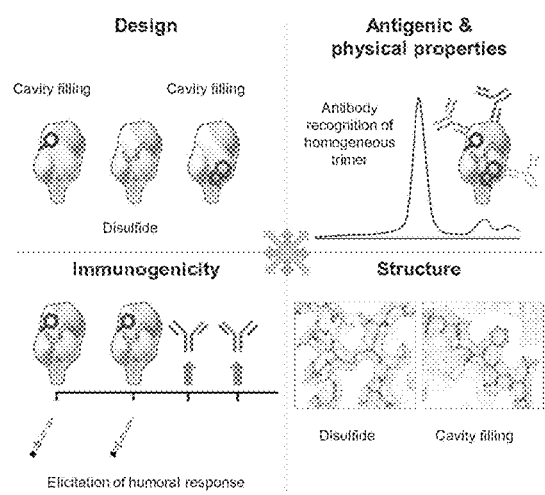
FIG. 26C
FIG. 26B
Structural definition of a supersite
of viral vulnerability
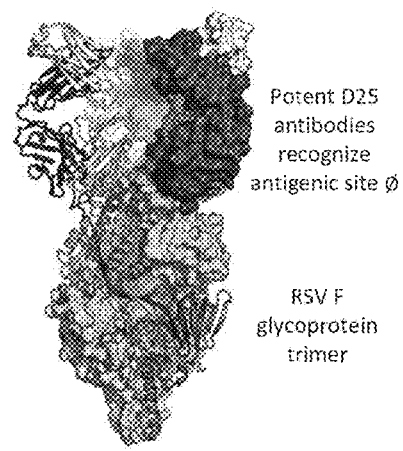
Elicitation of protective responses
with a supersite immunogen
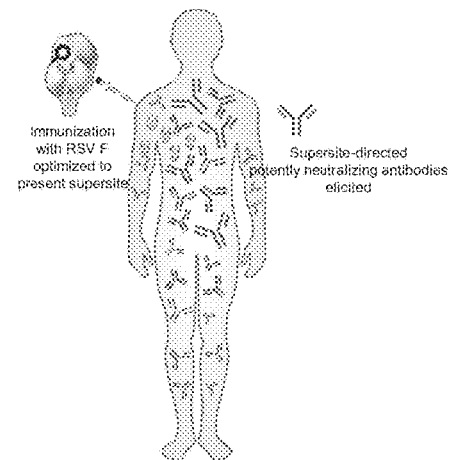
FIG. 26D

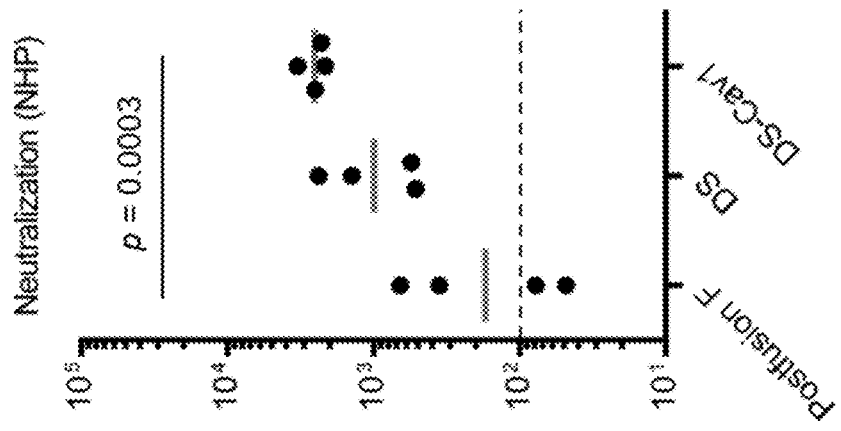
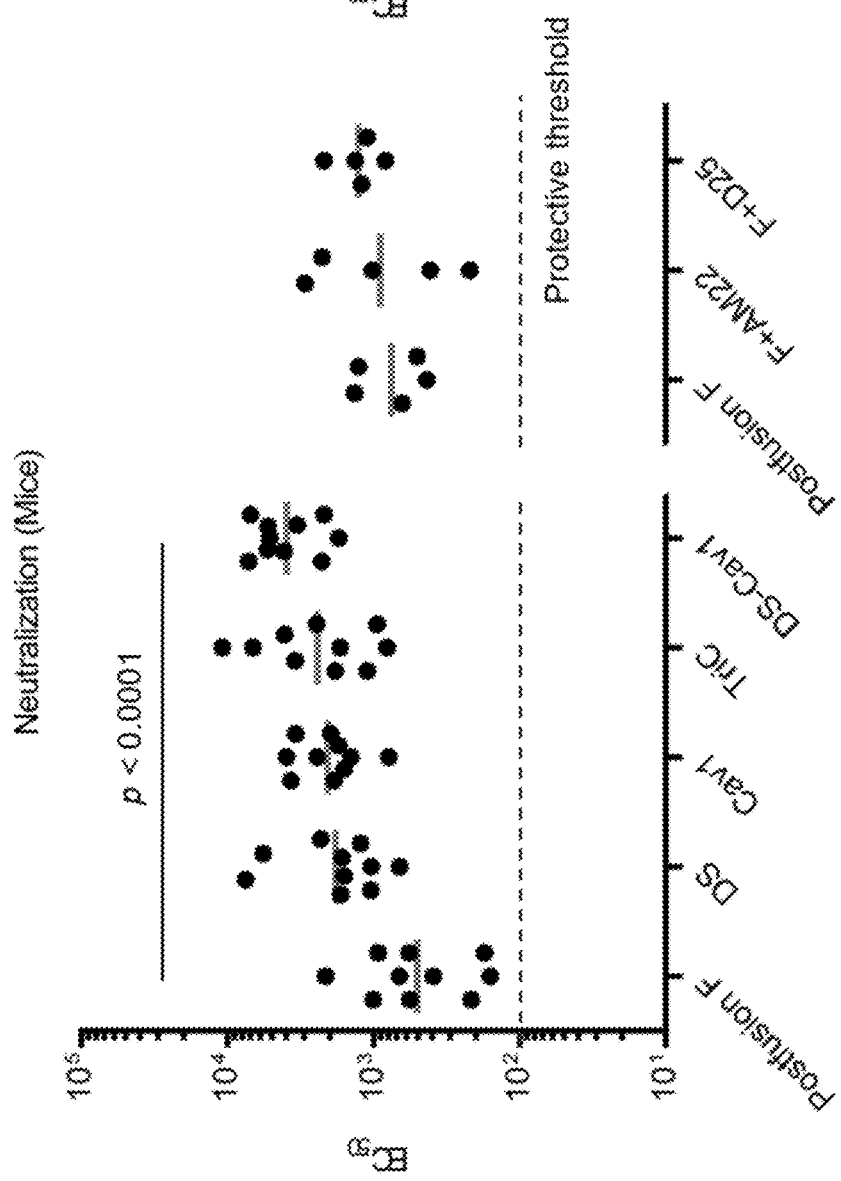
FIG. 29B
FIG. 29A

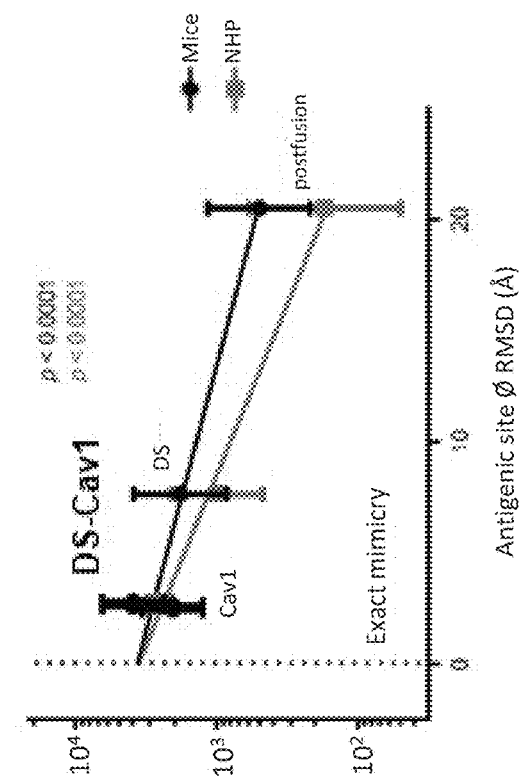
FIG. 30B
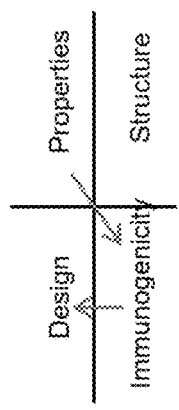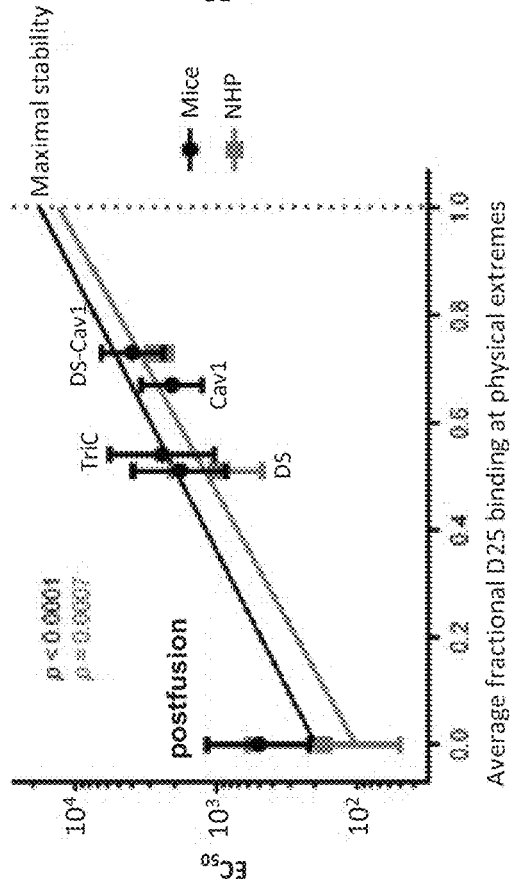
FIG. 30A

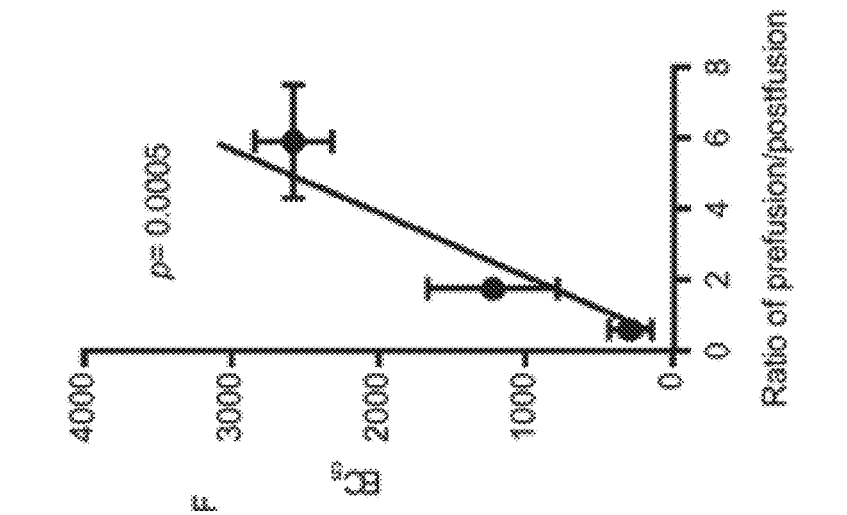
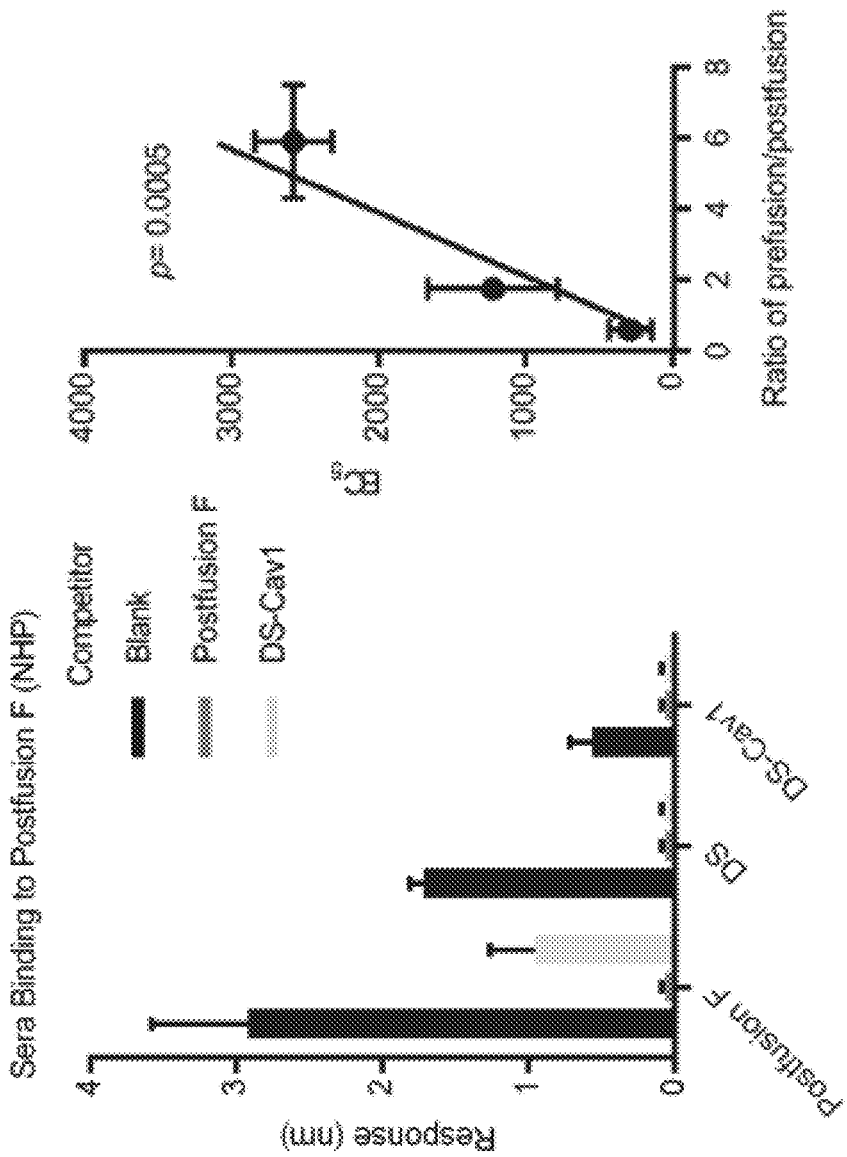
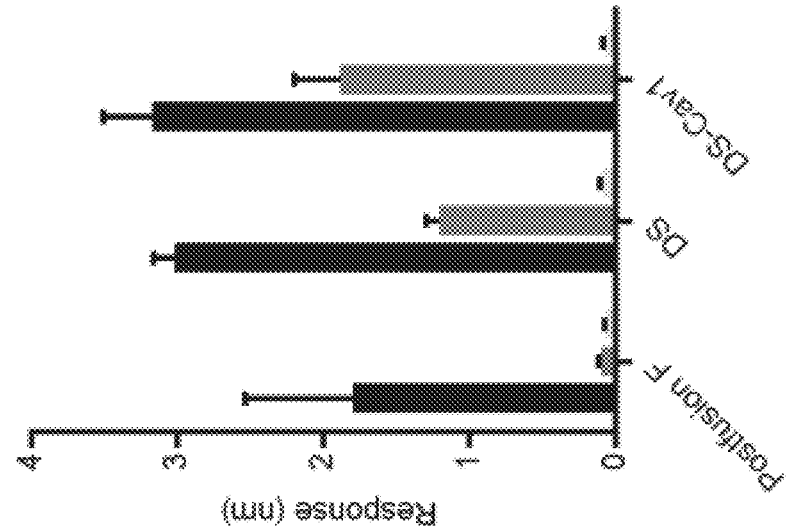
FIG. 30C
FIG. 30D

FIG. 31A

| RSV F variant | Oligomeric state# | Yield (mg/L)* | Antibody $K_D$ value (nM) | | | | | | |
|---|---|---|---|---|---|---|---|---|---|
| | | | Site Ø | | | Site I | Site II | | Site IV |
| | | | D25 | AM22 | 5C4 | 131-2a | Paliv | Mota | 101 F |
| K87F, V90L | Aggregate | 0.3 | >1000 | >1000 | >1000 | 7.6 | 1.68 | 0.17 | 1.57 |
| F137W, F140W | N.D. | <0.1 | N/A | N/A | N/A | N/A | N/A | N/A | N/A |
| F137W, F140W, F488W | N.D. | <0.1 | N/A | N/A | N/A | N/A | N/A | N/A | N/A |
| S155C, S290C (DS) | Trimer | 1.4 | 0.3 | <0.01 | 35.4 | 3.4 | 2.8 | 0.04 | 2.2 |
| V178N | Aggregate | <0.1 | >1000 | >1000 | >1000 | 7.18 | 3.13 | 0.11 | 1.64 |
| V185E | Aggregate | <0.1 | >1000 | >1000 | >1000 | 3.53 | 1.70 | 0.11 | 1.64 |
| S190F, V207L (Cav1) | Trimer | 2.2 | 0.23 | <0.10 | 9.31 | >1000 | 42.90 | <0.01 | 2.94 |
| S190F, V296F (Cav2) | Aggregate | 0.4 | >1000 | >1000 | >1000 | 4.17 | 1.67 | <0.01 | 1.59 |
| V207L, V220L (Cav3) | Aggregate | 0.4 | >1000 | >1000 | >1000 | 2.79 | 0.99 | 0.01 | 0.69 |
| T357C, N371C | N.D. | <0.1 | N/A | N/A | N/A | N/A | N/A | N/A | N/A |
| S403C, T420C | Aggregate | 0.3 | >1000 | >1000 | >1000 | 3.05 | 3.31 | 0.05 | 1.85 |
| D486H, E487Q, D489H | Aggregate | 0.1 | >1000 | >1000 | >1000 | >1000 | 9.5 | 0.57 | 12.7 |
| D486H, E487Q, D489H, F488W (TriC) | Trimer | 0.8 | 0.01 | 1.0 | 33.6 | >1000 | 30.7 | 0.5 | 4.0 |
| F488W | Trimer | 1.7 | 0.09 | 0.25 | 26.89 | >1000 | 31.6 | 0.1 | 4.74 |
| I506K | Aggregate | <0.1 | >1000 | >1000 | >1000 | 4.55 | 1.71 | 0.05 | 1.39 |
| Doubles | | | | | | | | | |
| DS, Cav1 | Trimer | 1.9 | 0.2 | <0.01 | 13.2 | >1000 | 23.4 | 0.04 | 3.2 |
| DS, TriC | Trimer | 0.6 | 0.17 | <0.01 | 33 | | 4.8 | 0.05 | 3.1 |
| Cav1, TriC | Trimer | 0.2 | 0.99 | 0.086 | 5.1 | >1000 | 32.28 | 0.17 | 3.09 |
| Triple | | | | | | | | | |
| DS, Cav1, TriC | Trimer | 1.3 | 0.17 | 0.02 | 17.8 | >1000 | 19.72 | 0.10 | 3.17 |

FIG. 31B

| RSV F variant | Physical characterization (fractional D25 reactivity) | | | | | | | |
|---|---|---|---|---|---|---|---|---|
| | Temp (°) | | | pH | | Osmolality (mM) | | Freeze-Thaw |
| | 50 | 70 | 90 | 3.5 | 10.0 | 10 | 3000 | 10x |
| K87F, V90L | N/A | N/A | N/A | N/A | N/A | N/A | N/A | N/A |
| F137W, F140W | N/A | N/A | N/A | N/A | N/A | N/A | N/A | N/A |
| F137W, F140W, F488W | N/A | N/A | N/A | N/A | N/A | N/A | N/A | N/A |
| S155C, S290C (DS) | 0.3 | 0 | 0 | 0.1 | 0.8 | 1.3 | 0.8 | 0.3 |
| V178N | N/A | N/A | N/A | N/A | N/A | N/A | N/A | N/A |
| V185E | N/A | N/A | N/A | N/A | N/A | N/A | N/A | N/A |
| S190F, V207L (Cav1) | 0.8 | 0.1 | 0.1 | 0.7 | 0.8 | 1.0 | 0.7 | 0.6 |
| S190F, V296F (Cav2) | N/A | N/A | N/A | N/A | N/A | N/A | N/A | N/A |
| V207L, V220L (Cav3) | N/A | N/A | N/A | N/A | N/A | N/A | N/A | N/A |
| T357C, N371C | N/A | N/A | N/A | N/A | N/A | N/A | N/A | N/A |
| S403C, T420C | N/A | N/A | N/A | N/A | N/A | N/A | N/A | N/A |
| D486H, E487Q, D489H | N/A | N/A | N/A | N/A | N/A | N/A | N/A | N/A |
| D486H, E487Q, D489H, F488W (TriC) | 0.8 | 0.1 | 0.1 | 0.1 | 0.8 | 1.3 | 0.6 | 0.1 |
| F488W | 0.9 | 0.1 | 0 | 0.1 | 0.7 | 1.1 | 0.5 | 0 |
| I506K | N/A | N/A | N/A | N/A | N/A | N/A | N/A | N/A |
| Doubles | | | | | | | | |
| DS, Cav1 | 0.9 | 0 | 0 | 0.8 | 0.9 | 1.0 | 0.8 | 0.7 |
| DS, TriC | 0.9 | 0 | 0 | 0.3 | 0.9 | 0.5 | 0.9 | 0.5 |
| Cav1, TriC | 0.9 | 0.1 | 0.1 | 0.3 | 0.8 | 0.6 | 0.5 | 0 |
| Triple | | | | | | | | |
| DS, Cav1, TriC | 0.9 | 0.1 | 0.1 | 0.6 | 0.9 | 0.6 | 0.6 | 0 |

FIG. 32
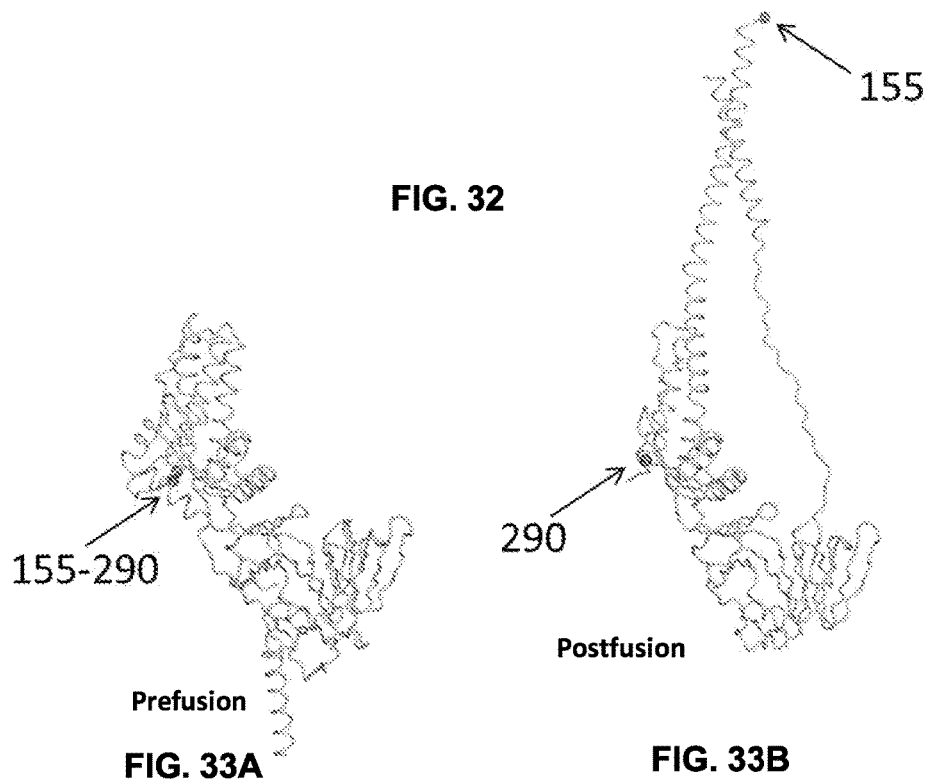
FIG. 33A  FIG. 33B
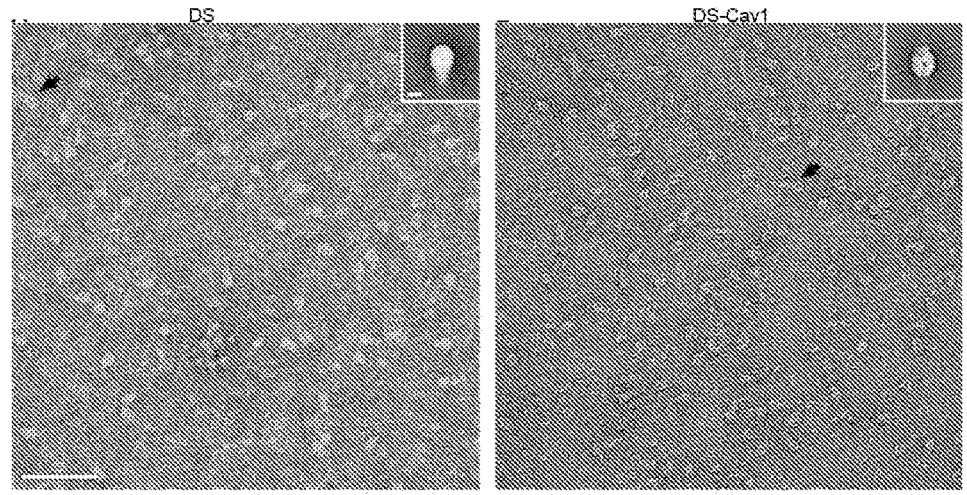
FIG. 33C

FIG. 38A

Prime at day 0

1 RSV F DS-Cav1+Poly I:C
2 RSV F DS+Poly I:C
3 RSV F Postfusion RSV F+Poly I:C

FIG. 38B

Boost at week 4

1 RSV F DS-Cav1+Poly I:C
2 RSV F DS+Poly I:C
3 RSV F Postfusion+Poly I:C

FIG. 39A
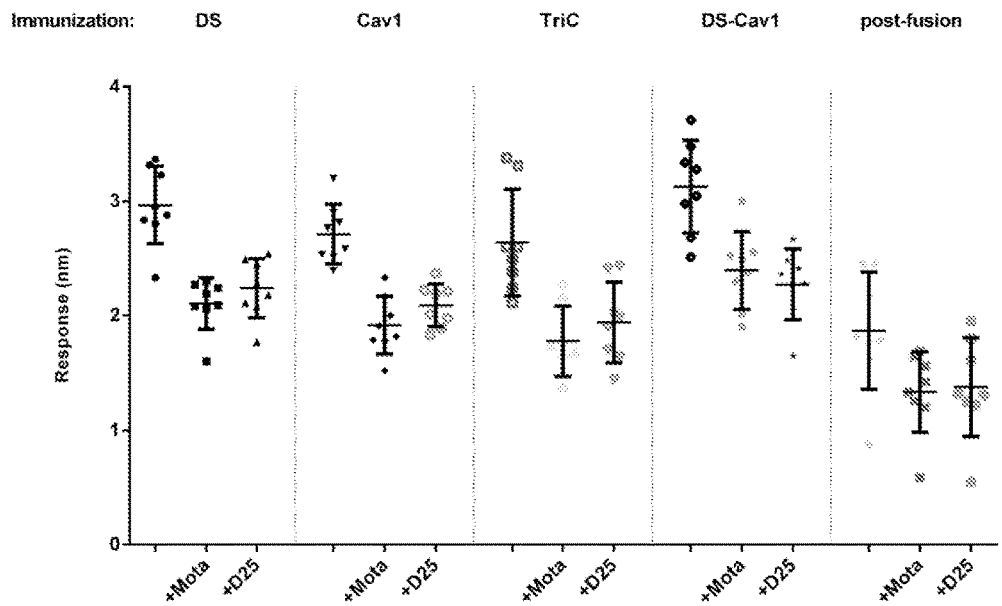
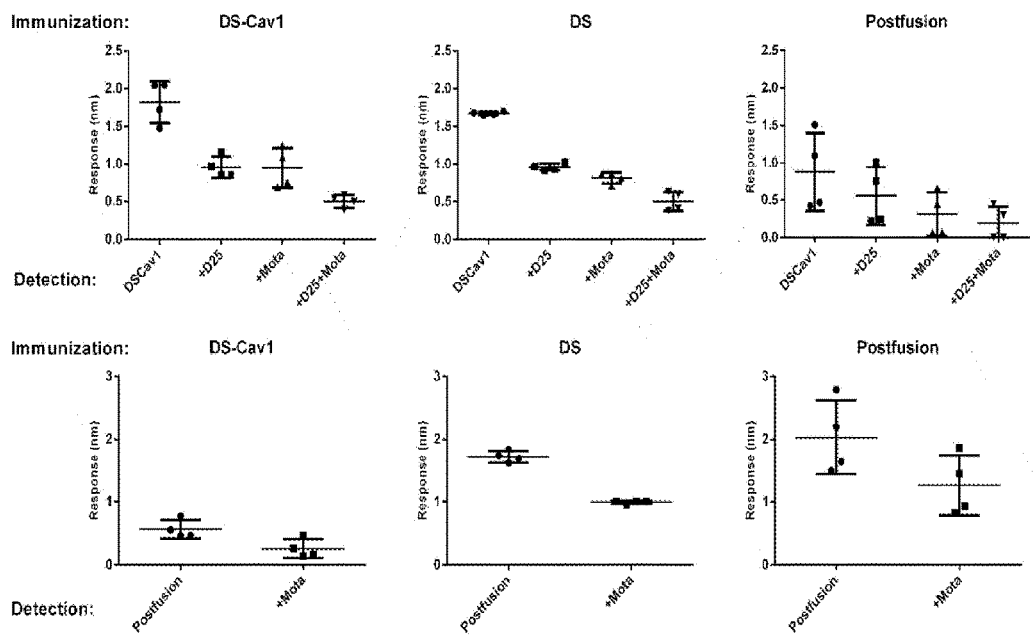
FIG. 39B

Table S1. Crystallographic data collection and refinement statistics

| | DS (pH 9.5) | Cav1 (pH 9.5) | Cav1 (pH 5.5) | DS-Cav1 (pH 9.5) | DS-Cav1 (pH 5.5) | DS-Cav1-InC (pH 9.5) |
|---|---|---|---|---|---|---|
| Data collection | | | | | | |
| Space group | P4₃2₁2 | P4₃2₁2 | P4₂2₁2 | P4₂2₁2 | P4₂2₁2 | P4₂2₁2 |
| Cell constants | | | | | | |
| a, b, c (Å) | 168.4, 168.4, 168.4 | 170.9, 170.9, 170.9 | 170.7, 170.7, 163.9 | 168.6, 168.6, 168.6 | 168.6, 168.6, 168.6 | 170.4, 170.4, 170.4 |
| α, β, γ (°) | 90.0, 90.0, 90.0 | 90.0, 90.0, 90.0 | 90.0, 90.0, 90.0 | 90.0, 90.0, 90.0 | 90.0, 90.0, 90.0 | 90.0, 90.0, 90.0 |
| Wavelength (Å) | 1.00 | 1.00 | 1.00 | 1.00 | 1.00 | 1.00 |
| Resolution (Å) | 50-3.25 (3.31-3.25) | 50-3.1 (3.21-3.1) | 50-2.40 (2.49-2.40) | 50-3.85 (3.99-3.85) | 50-3.0 (3.11-3.0) | 50-2.8 (2.90-2.80) |
| $R_{merge}$ | 14.8 (64.3) | 20.3 (70.7) | 11.1 (59.8) | 21.4 (95.3) | 13.0 (79.3) | 13.0 (92.6) |
| I/σI | 14.8 (2.2) | 11.8 (1.5) | 12.6 (2.1) | 9.1 (1.2) | 22.4 (2.2) | 42.9 (1.8) |
| Completeness (%) | 99.6 (96.4) | 99.1 (91.7) | 95.6 (97.7) | 98.5 (89.9) | 99.8 (98.1) | 99.9 (99.4) |
| Redundancy | 8.3 (4.1) | 11.7 (3.8) | 4.4 (4.0) | 8.1 (4.3) | 16.3 (7.5) | 12.6 (6.2) |
| Refinement | | | | | | |
| Resolution (Å) | 3.25 | 3.10 | 2.40 | 3.85 | 3.00 | 2.80 |
| Unique reflections | 13,345 | 15,925 | 90,779 | 8,287 | 16,999 | 21,005 |
| $R_{work}/R_{free}$ (%) | 23.7, 27.4 | 20.6, 23.7 | 18.7, 21.4 | 24.7, 28.6 | 18.6, 23.9 | 22.5, 25.9 |
| No. atoms | | | | | | |
| Protein | 3033 | 3546 | 10,421 | 3523 | 3526 | 3771 |
| Ligand/ion | 30 | - | 70 | - | 156 | - |
| Water | 0 | 39 | 522 | - | 108 | 69 |
| B-factors (Å²) | | | | | | |
| Protein | 75.1 | 114.9 | 56.4 | 198.7 | 76.3 | 106.9 |
| Ligand/ion | 136.4 | - | 101.5 | - | 155.8 | - |
| Water | - | 87.6 | 48.5 | - | 62.4 | 80.0 |
| R.m.s. deviations | | | | | | |
| Bond lengths (Å) | 0.008 | 0.012 | 0.003 | 0.011 | 0.010 | 0.005 |
| Bond angles (°) | 1.35 | 1.24 | 0.84 | 1.67 | 1.42 | 0.93 |
| Ramachandran | | | | | | |
| Favored regions (%) | 95.8 | 95.3 | 95.1 | 93.4 | 93.3 | 96.2 |
| Allowed regions (%) | 3.9 | 4.3 | 4.5 | 5.3 | 6.0 | 3.3 |
| Disallowed regions (%) | 0.3 | 0.4 | 0.4 | 1.3 | 0.7 | 0.5 |

Values in parentheses are for highest-resolution shell

| Construct | Prefusion Stabilization | | | Linker length | | | | Production | |
|---|---|---|---|---|---|---|---|---|---|
| | Variant | Trimerization domain | C-terminal residue | Linker end points | Linker length | Linker sequence | | Oligomeric state | Yield (mg/L) |
| 3 | DS-Cav1 | Foldon | 513 | 97-150 | 9 | GSGNGLGG | | Trimer | 2.6 |
| 4 | DS | Foldon | 513 | 97-150 | 11 | GSGGKGIGLGG | | N.D. | N.D. |
| | DS-Cav1 | | 513 | 97-150 | 11 | GSGKHGIGLGG | | Trimer | 3.4 |
| | a | | 513 | 97-150 | 11 | GSGGKGIGLGG | | N.D. | N.D. |
| 6 | DS | | 513 | 97-150 | 8 | GSGMLGG | | N.D. | N.D. |
| | DS-Cav1 | | 513 | 97-150 | 8 | GSGMLGG | | Trimer | 1.0 |
| 7 | DS | CPC | 491 | 97-150 | 9 | GSGWGLGG | | N.D. | N.D. |
| | Cav1 | CPC | 491 | 97-150 | 9 | GSGWGLGG | | Aggregate | 0.45 |
| | DS-Cav1 | CPC | 491 | 97-150 | 9 | GSGWHGG | | Aggregate | 0.3 |
| 8 | DS | CC | 511 | 97-150 | 9 | GSGWGLGG | | Monomer | 0.6 |
| | | CC | 511 | 97-150 | 9 | | | Trimer | 0.5 |
| | DS-Cav1 | CC | 511 | 97-150 | 9 | GSGKHGLGG | | Monomer | 0.8 |
| | | None | 511 | 97-150 | 2 | | | Trimer | 1.0 |
| | DS-Cav1 | | 511 | 97-150 | 2 | GSGWHGG | | Monomer | 0.5 |
| | | | 511 | 97-150 | 2 | | | Trimer | 0.6 |
| 9 | DS-Cav1 | Foldon | 513 | 105-145 | 2 | GS | | Trimer | 3.1 |
| | a | Foldon | 513 | 105-145 | 2 | GS | | Trimer | 4.8 |
| | DS | Foldon | 513 | 105-145 | 2 | GS | | Trimer | 4.3 |
| | Cav1 | Foldon | 513 | 105-145 | 2 | GS | | Trimer | 5.8 |
| 10 | DS | CPC | 491 | 105-145 | 2 | GS | | Monomer | 0.3 |
| | | | 491 | | | | | Trimer | 0.4 |
| | DS-Cav1 | CPC | 491 | 105-145 | 2 | GS | | Monomer | 0.5 |
| | | | 491 | | | | | Trimer | 0.5 |
| 11 | DS | CC | 513 | 105-145 | 2 | GS | | Monomer | 0.8 |
| | Cav1 | CC | 513 | 105-145 | 2 | GS | | Monomer | 1.0 |

FIG. 47

| Construct | Variant | Antibody K_D value (nM) | | | | | |
|---|---|---|---|---|---|---|---|
| | | Site Ø | | Site II* | | Site IV | |
| | | D25 | AM22 | 5C4 | Paliv | Mota | 101F |
| F(+) | DS-Cav1 | 0.15 | <0.01 | 13 | 23 | 0.04 | 3.2 |
| scF no. 9 | DS-Cav1 | 0.06 | 0.1 | 6.0 | 4.0 | 8.9 | 2.7 |

$ Paliv

FIG. 48

| Data collection and refinement | Single-chain RSV F no. 9 DS-Cav1 |
|---|---|
| Space group | P $4_1$ 3 2 |
| Resolution (Å) | 50-3.21 (3.36-3.21) |
| $I/\sigma I$ | 2.84 |
| No. reflections | 521334 |
| Unique reflections | 76368 |
| Completeness (%) | 98 |
| Average redundancy | 4.3 |
| $R_{work}$ / $R_{free}$ (%) | 19.3 / 23.9 |

R = $\Sigma hkl||Fobs| - |Fcalc||/\Sigma hkl|Fobs|$.
$R_{free}$ is calculated from 5% of the reflections excluded from refinement.

FIG. 53    Week 5 neutralization data 10 animals/group

FIG. 54 Single chain linker region may be improved by removing Proline 101 or shortening/mutating the linker residues and adjacent residues

FIG. 57 Physical stability of #669 linked to Ferritin compared to RSV F DS-Cav1

FIG. 58A RSV subtype A (GMT)

FIG. 58B RSV subtype B (GMT)

FIG. 58C

|  | DS-Cav1 | Ferritin single-chain DS-Cav1 | Single chain BZGJ9 DS-Cav1 |
|---|---|---|---|
| Number of values | 4 | 4 | 4 |
| Mean | 4.666 | 10.41 | 1.25 |
| Std. Deviation | 6.974 | 12.86 | 2.5 |
| Std. Error of Mean | 3.487 | 6.431 | 1.25 |
| Geometric mean | 0.2038 | 0.5074 | 0.0002659 |

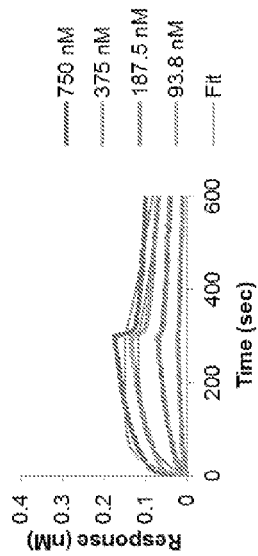
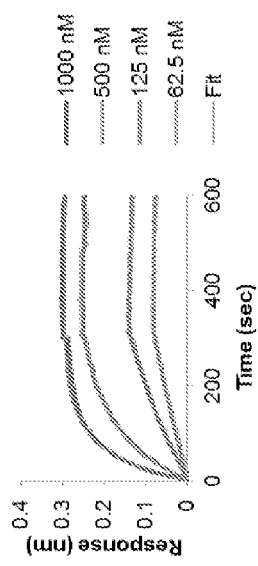
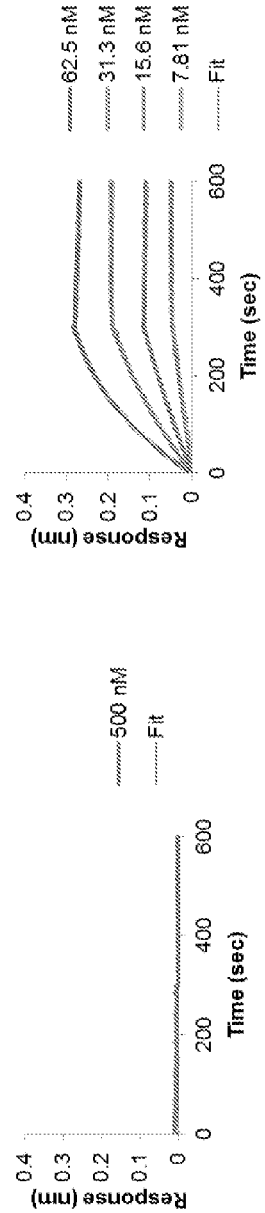
FIG. 61A

FIG. 61B

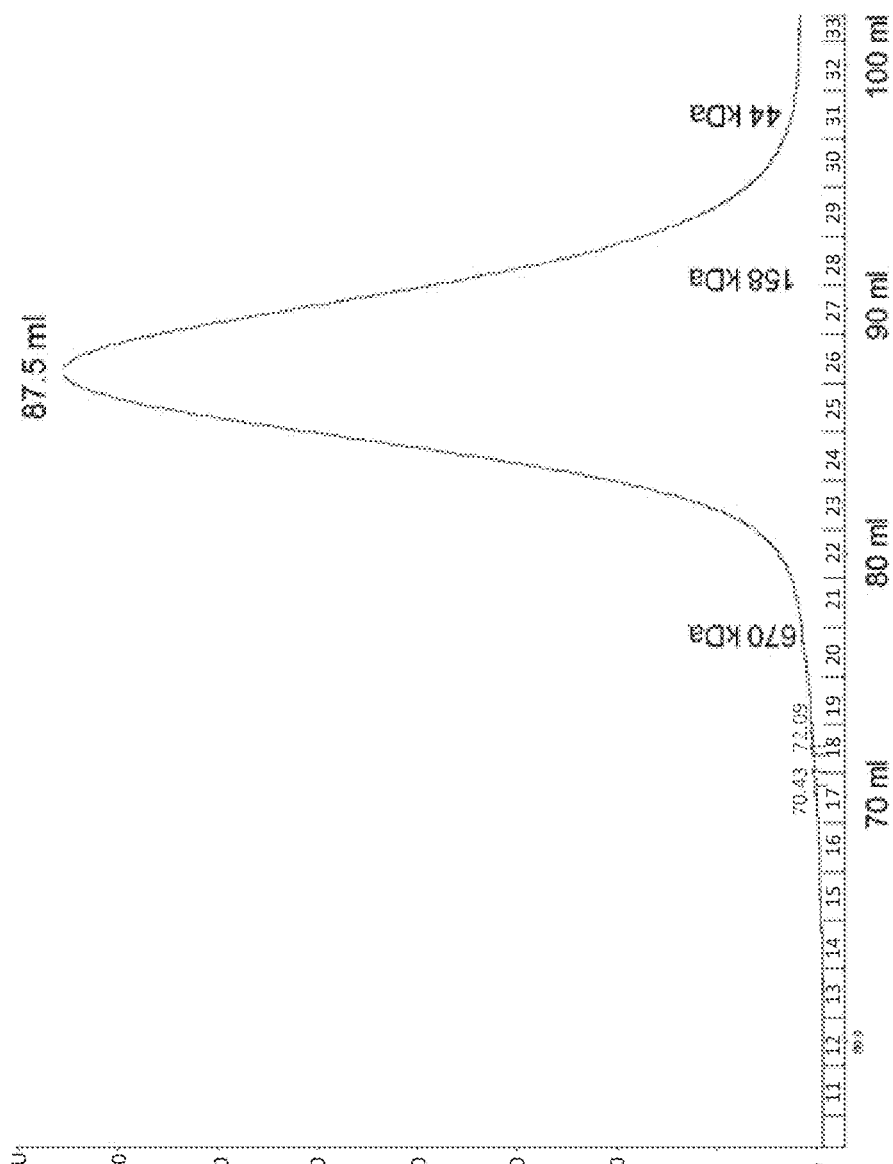
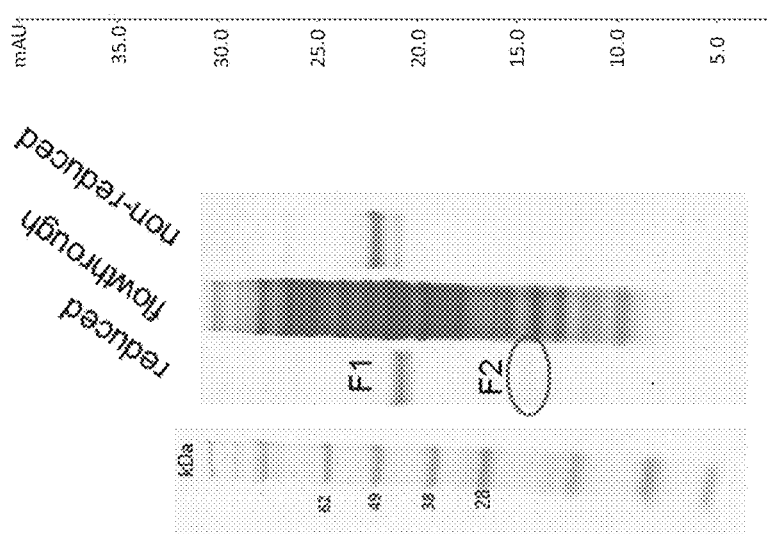
FIG. 62A
FIG. 62B

FIG. 65 Gel filtration profiles of RSV F proteins

FIG. 66 Interprotomer disulfides stabilizing F protein trimer after removal of the foldon

FIG. 69A

| | SEQ ID NO | Condition (1) | (2) | (3) | (4) | (5) | (6) |
|---|---|---|---|---|---|---|---|
| [illegible] | | [illegible] | 2.629 | 0.079 | 2.456 | [illegible] | [illegible] |
| GSJ 1Cav1 1 | 901 | [illegible] | 2.9999 | 0.0598 | 2.494 | [illegible] | [illegible] |
| GSJ 1Cav1 2 | 902 | [illegible] | 2.8486 | 0.0934 | 2.721 | [illegible] | [illegible] |
| GSJ 1Cav1 3 | 903 | [illegible] | 2.9517 | 0.0604 | 2.267 | [illegible] | [illegible] |
| GSJ 1Cav1 4 | 904 | [illegible] | 2.9117 | 0.0881 | 1.532 | 0.0919 | [illegible] |
| GSJ 1Cav1 5 | 905 | [illegible] | 2.9964 | 0.0619 | 2.331 | [illegible] | [illegible] |
| GSJ 1Cav1 6 | 906 | [illegible] | 3.0238 | 0.0601 | 2.28 | 0.3496 | [illegible] |
| GSJ 1Cav1 7 | 907 | [illegible] | 3.049 | 0.0896 | 2.557 | [illegible] | [illegible] |
| GSJ 1Cav1 8 | 908 | 1.5173 | 2.151 | 0.0533 | 0.622 | 0.1222 | 1.2086 |
| GSJ 1Cav1 9 | 909 | 0.0664 | 0.1252 | [illegible] | 0.071 | 0.0666 | 0.2809 |
| GSJ 1Cav1 10 | 910 | [illegible] | 3.0756 | 0.075 | 2.455 | [illegible] | [illegible] |
| GSJ 1Cav1 11 | 911 | [illegible] | 3.049 | 0.0642 | 2.473 | [illegible] | [illegible] |
| GSJ 1Cav1 12 | 912 | [illegible] | 2.9347 | 0.081 | 1.685 | [illegible] | [illegible] |
| GSJ 1Cav1 13 | 913 | [illegible] | 3.093 | 0.0718 | 2.491 | [illegible] | [illegible] |
| GSJ 1Cav1 14 | 914 | 0.074 | 0.1171 | 0.0865 | 0.11 | 0.058 | [illegible] |
| GSJ 1Cav1 15 | 915 | [illegible] | 2.9177 | 0.0566 | 2.248 | 0.1957 | [illegible] |
| GSJ 1Cav1 16 | 916 | [illegible] | 3.0962 | 0.0931 | 2.524 | 0.699 | [illegible] |
| GSJ 1Cav1 17 | 917 | [illegible] | 3.1047 | 0.0891 | 2.147 | 0.6287 | [illegible] |
| GSJ 1Cav1 18 | 918 | [illegible] | 2.9848 | 0.1134 | 2.34 | [illegible] | [illegible] |
| GSJ 1Cav1 20 | 920 | [illegible] | 2.9874 | 0.0728 | 2.379 | 0.1579 | [illegible] |
| GSJ 1Cav1 21 | 921 | [illegible] | 2.9259 | 0.0535 | 2.28 | 0.1022 | [illegible] |
| GSJ 1Cav1 22 | 922 | [illegible] | 2.8613 | 0.072 | 2.168 | 0.1202 | [illegible] |
| GSJ 1Cav1 23 | 923 | [illegible] | 3.0166 | 0.0689 | 2.378 | 0.1273 | [illegible] |
| GSJ 1Cav1 24 | 924 | [illegible] | 2.7995 | [illegible] | 2.754 | 0.2752 | [illegible] |
| GSJ 1Cav1 25 | 925 | [illegible] | 3.1097 | 0.1162 | 2.192 | 0.369 | [illegible] |
| GSJ 1Cav1 26 | 926 | [illegible] | 3.0849 | 0.1055 | 2.268 | 0.4974 | [illegible] |
| GSJ 1Cav1 27 | 927 | [illegible] | 3.0256 | 0.0626 | 2.322 | 0.3391 | [illegible] |
| GSJ 1Cav1 28 | 928 | 0.8729 | 2.3566 | 0.0761 | 1.891 | 0.082 | [illegible] |
| GSJ 1Cav1 29 | 929 | [illegible] | 3.1072 | 0.0572 | 2.309 | [illegible] | [illegible] |
| GSJ 1Cav1 30 | 930 | [illegible] | 2.928 | 0.0764 | 2.2 | 0.1129 | [illegible] |
| GSJ 1Cav1 31 | 931 | [illegible] | 2.997 | 0.0716 | 2.22 | 0.2543 | [illegible] |
| GSJ 1Cav1 32 | 932 | [illegible] | 2.9971 | 0.1275 | 2.826 | 0.097 | [illegible] |
| GSJ 1Cav1 33 | 933 | [illegible] | 2.7011 | 0.0517 | 2.664 | 0.0884 | [illegible] |
| GSJ 1Cav1 34 | 934 | [illegible] | 2.9784 | 0.0619 | 2.387 | 0.1185 | [illegible] |
| GSJ 1Cav1 35 | 935 | [illegible] | 2.8824 | 0.0603 | 2.253 | 0.0877 | [illegible] |
| GSJ 1Cav1 36 | 936 | [illegible] | 2.9404 | 0.0976 | 2.19 | 0.1221 | [illegible] |
| GSJ 1Cav1 37 | 937 | [illegible] | 2.9104 | 0.08 | 2.092 | 0.0919 | [illegible] |
| GSJ 1Cav1 38 | 938 | [illegible] | 2.858 | 0.0559 | 1.923 | 0.0572 | [illegible] |
| JCB GSJ 1 | 939 | [illegible] | 2.8762 | 0.0932 | 2.551 | 0.8961 | [illegible] |

FIG. 69B

| | SEQ ID NO | (1) | (2) | (3) | (4) | (5) | (6) |
|---|---|---|---|---|---|---|---|
| JCB GSJ 2 | 940 | | 2.8462 | 0.0988 | 2.103 | 0.1986 | |
| JCB GSJ 3 | 941 | | 2.9573 | 0.1007 | 2.717 | | |
| JCB GSJ 4 | 942 | | 2.9605 | 0.0842 | 2.239 | | |
| JCB GSJ 5 | 943 | | 2.9654 | 0.0783 | 2.059 | | |
| IG1-V192M | 944 | 0.0622 | 0.1164 | 0.053 | 0.146 | 0.0632 | 0.3497 |
| IG2-A298M_RSVF(+)FdTHS-paH | 945 | | 3.0139 | 0.1081 | 2.686 | 0.3677 | |
| IG2-T58I_A298M | 946 | | 2.9796 | 0.0866 | 2.645 | | |
| IG2-T58I_V192F_A298I_RSVF(+)FdTHS-paH | 947 | 0.0912 | 0.0934 | 0.0882 | 0.127 | 0.0734 | 0.1541 |
| IG2-T58I_V192M_A298I_RSVF(+)FdTHS-paH | 948 | 0.0908 | 0.1119 | 0.0825 | 0.11 | 0.0832 | 0.7898 |
| i167m-a298m | 949 | 0.0995 | 0.3355 | 0.0492 | 0.345 | 0.0628 | 0.7184 |
| i167m-l181m | 950 | 0.0579 | 0.2538 | 0.052 | 0.367 | 0.0772 | 0.6506 |
| i199f | 951 | | 2.7464 | 0.4405 | 2.429 | 0.2993 | |
| i57c-s190c | 952 | 0.2652 | 0.5291 | 0.0661 | 0.094 | 0.0725 | 0.461 |
| ig2-t58i-a298m | 953 | 1.0703 | 1.5305 | 0.0717 | 0.552 | 0.1018 | 1.2218 |
| ig2-t58m | 954 | | 2.9985 | 0.1685 | 2.792 | 0.797 | |
| ig2-t58m-a298i | 955 | | 2.8545 | 0.056 | 2.765 | 0.8859 | |
| ig2-t58m-a298L | 956 | | 2.9793 | 0.0979 | 2.795 | | |
| ig2-v192c-ins192-193-g-e256c | 957 | 0.0696 | 0.1069 | 0.0556 | 0.11 | 0.0852 | 0.3724 |
| rsv_f_ths_s_f505w_o_s509f | 958 | 2.1277 | 2.6243 | 0.1037 | 1.738 | | |
| rsv_f_ths_s_f505w_s509f | 959 | 1.3529 | 1.6774 | 0.1193 | 0.158 | 1.4003 | |
| t58i-a298i | 960 | 2.6436 | 2.6535 | 0.0875 | 2.243 | 0.2619 | |
| t58m-a298m | 961 | 2.8387 | 2.715 | 0.1073 | 2.712 | | |
| v179i-t199f | 962 | 0.656 | 1.2011 | 0.0499 | 0.824 | 0.0621 | 0.9012 |
| v192f | 963 | 0.053 | 0.178 | 0.0816 | 0.186 | 0.0609 | 0.318 |
| v192f-l252a | 964 | 0.0515 | 0.0803 | 0.1396 | 0.074 | 0.0663 | 0.3239 |
| v56m-i167m-l181m | 965 | 0.0464 | 0.0855 | 0.062 | 0.071 | 0.0549 | 0.4498 |
| v56m-i167m-v296m | 966 | 0.0521 | 0.1116 | 0.0754 | 0.111 | 0.0518 | 0.4902 |
| v56m-l181f | 967 | 0.0511 | 0.1818 | 0.1008 | 0.475 | 0.0612 | 0.4797 |
| w52c-s150c | 968 | 0.1112 | 0.2253 | 0.0782 | 0.103 | 0.08 | 0.3339 |
| GSJT12 | 859 | | 1.9726 | 0.0574 | 0.166 | | |
| GSJT13 | 860 | 1.4253 | 1.7736 | 0.0572 | 0.144 | | |
| GSJT14 | 861 | | 2.3344 | 0.0737 | 0.422 | | |
| GSJT15 | 862 | 1.5401 | 1.7335 | 0.0752 | 0.114 | | |
| GSJT16 | 863 | 1.3708 | 1.6619 | 0.062 | 0.093 | | |
| GSJT17 | 864 | 1.2053 | 1.5253 | 0.0702 | 0.103 | | |
| GSJT18 | 865 | 1.181 | 1.5089 | 0.1298 | 0.272 | 1.1712 | |

FIG. 69C

|         | SEQ ID NO | (1)    | (2)    | (3)    | (4)   | (5)    | (6)    |
|---------|-----------|--------|--------|--------|-------|--------|--------|
| GSJT19  | 866       | 0.9276 | 1.2456 | 0.0869 | 0.161 | 0.9697 |        |
| GSJT20  | 867       | 0.934  | 1.3047 | 0.0527 | 0.154 | 0.9109 |        |
| GSJT21  | 868       | 1.1944 | 1.4919 | 0.1448 | 0.159 | 1.3432 |        |
| GSJT22  | 869       |        | 2.556  | 0.0687 | 0.594 |        |        |
| GSJT23  | 870       | 1.0262 | 1.3655 | 0.0679 | 0.257 | 1.1962 |        |
| GSJT24  | 871       |        | 2.1459 | 0.0885 | 0.255 |        |        |
| GSJT25  | 872       | 0.8893 | 1.43   | 0.0931 | 0.361 | 0.8439 |        |
| GSJT26  | 873       |        | 2.0503 | 0.0532 | 0.421 |        |        |
| GSJT27  | 874       | 1.0373 | 1.4579 | 0.0577 | 0.419 | 0.8234 |        |
| GSJT28  | 875       |        | 2.0962 | 0.0566 | 0.346 |        |        |
| GSJT29  | 876       | 1.1084 | 1.5343 | 0.0723 | 0.408 | 0.8422 |        |
| GSJT30  | 877       | 1.5348 | 1.9793 | 0.1053 | 0.354 |        |        |
| GSJT31  | 878       |        | 2.1351 | 0.0569 | 0.284 |        |        |
| GSJT32  | 879       |        | 1.9587 | 0.0518 | 0.296 |        |        |
| GSJT33  | 880       |        | 1.9659 | 0.0586 | 0.228 |        |        |
| GSJT34  | 881       |        | 1.9678 | 0.0969 | 0.398 |        |        |
| GSJT35  | 882       |        | 2.1785 | 0.0773 | 0.34  |        |        |
| GSJT36  | 883       |        | 1.9904 | 0.0934 | 0.296 |        |        |
| GSJT37  | 884       |        | 1.9141 | 0.0612 | 0.342 |        |        |
| GSJT38  | 885       |        | 2.0942 | 0.0599 | 0.13  |        |        |
| GSJT39  | 886       |        | 2.07   | 0.0611 | 0.113 |        |        |
| GSJT40  | 887       |        | 1.8917 | 0.0645 | 0.177 |        |        |
| GSJT41  | 888       |        | 1.824  | 0.081  | 0.151 |        |        |
| GSJT42  | 889       |        | 2.252  | 0.069  | 0.352 |        |        |
| GSJT43  | 890       |        | 2.0164 | 0.0559 | 0.378 |        |        |
| GSJT44  | 891       | 1.3943 | 1.6933 | 0.0751 | 0.141 | 1.3954 |        |
| GSJT45  | 892       |        | 1.9654 | 0.0623 | 0.144 |        |        |
| GSJT46  | 893       |        | 2.0335 | 0.0673 | 0.231 | 1.39   |        |
| GSJT47  | 894       |        | 2.2091 | 0.0566 | 0.318 |        |        |
| GSJT48  | 895       |        | 2.1433 | 0.0875 | 0.682 |        |        |
| GSJT49  | 896       |        | 2.1642 | 0.0609 | 0.437 |        |        |
| GSJT50  | 897       |        | 1.999  | 0.0735 | 0.508 |        |        |
| GSJT51  | 898       |        | 2.2042 | 0.056  | 0.668 |        |        |
| GSJT52  | 899       |        | 2.2572 | 0.0635 | 0.791 | 1.4597 |        |
| GSJT53  | 900       |        | 1.899  | 0.0666 | 0.482 | 1.3792 |        |
| GSJ-FP1 | 969       |        | 2.1208 | 0.2051 | 0.399 |        |        |
| GSJ-FP2 | 970       |        | 2.4107 | 0.1963 | 0.515 |        |        |
| GSJ-FP3 | 971       | 0.126  | 0.234  | 0.0566 | 0.09  | 0.34   | 1.2832 |
| GSJ-FP4 | 972       | 0.1049 | 0.1701 | 0.0785 | 0.084 | 0.1021 | 0.6274 |
| GSJ-FP5 | 973       | 0.0891 | 0.178  | 0.0531 | 0.119 | 0.1454 | 0.5375 |

FIG. 69D

| | SEQ ID NO | (1) | (2) | (3) | (4) | (5) | (6) |
|---|---|---|---|---|---|---|---|
| GSJ-FP6 | 974 | 0.0634 | 0.0904 | 0.0525 | 0.066 | 0.0822 | 0.5962 |
| GSJ-190P1 | 975 | 0.8047 | 1.1312 | 0.0698 | 0.182 | 0.1205 | 0.6337 |
| GSJ-190P2 | 976 | 0.0573 | 0.0813 | 0.0523 | 0.065 | 0.0735 | 0.6404 |
| GSJ-190P3 | 977 | 0.0739 | 0.1148 | 0.0516 | 0.07 | 0.0653 | 0.3209 |
| GSJ-190P4 | 978 | 0.0924 | 0.083 | 0.0536 | 0.062 | 0.0807 | 0.2631 |
| GSJ-190P5 | 979 | [shaded] | 2.8717 | 0.0679 | 2.014 | 0.0989 | [shaded] |
| GSJ-190P6 | 980 | [shaded] | 2.9283 | 0.0697 | 2.401 | 0.4255 | [shaded] |
| GSJ-190P7 | 981 | [shaded] | 2.9739 | 0.0745 | 2.392 | 0.5633 | [shaded] |
| GSJ-190P8 | 982 | [shaded] | 2.6693 | 0.1063 | 2.27 | 0.175 | [shaded] |
| GSJ-190P9 | 983 | 0.0745 | 0.2046 | 0.0878 | 0.394 | 0.0654 | 0.7136 |
| GSJ-190P10 | 984 | 0.0601 | 0.2007 | 0.061 | 0.069 | 0.0564 | 0.4225 |
| GSJ-190P11 | 985 | 0.0699 | 0.0992 | 0.0595 | 0.107 | 0.0723 | 0.3176 |
| GSJ-190P12 | 986 | 0.0709 | 0.1044 | 0.0528 | 0.061 | 0.0895 | [shaded] |
| GSJ-190P13 | 987 | 0.0592 | 0.1057 | 0.0475 | 0.083 | 0.0985 | 0.2632 |
| GSJ-190P14 | 988 | 0.0583 | 0.0955 | 0.0468 | 0.058 | 0.0895 | 0.31 |
| GSJ-190P15 | 989 | 0.0539 | 0.1363 | 0.0486 | 0.233 | 0.0695 | 0.3087 |
| GSJ-190P16 | 990 | 0.0656 | 0.1091 | 0.1299 | 0.173 | 0.0791 | 0.492 |
| GSJ-190P17 | 991 | 0.0583 | 0.1179 | 0.0502 | 0.092 | 0.0981 | 0.292 |
| GSJ-DS1 | 992 | 0.0598 | 0.1296 | 0.0476 | 0.087 | 0.0823 | 0.3217 |
| GSJ-DS2 | 993 | 0.0517 | 0.0942 | 0.0487 | 0.069 | 0.0698 | 0.2403 |
| GSJ-DS3 | 994 | 0.0514 | 0.104 | 0.0714 | 0.084 | 0.0673 | 0.2739 |
| GSJ-DS4 | 995 | 0.0562 | 0.1153 | 0.0542 | 0.08 | 0.0685 | 0.2281 |
| GJ-3-1 | 996 | [shaded] | 2.91 | 0.0528 | 2.225 | 0.2481 | [shaded] |
| GJ-3-2 | 997 | [shaded] | 2.6384 | 0.0597 | 1.349 | 0.0674 | [shaded] |
| GJ-3-3 | 998 | [shaded] | 2.1696 | 0.0777 | 1.264 | 0.102 | [shaded] |
| GJ-3-4 | 999 | 0.5157 | 1.3561 | 0.0551 | 1.246 | 0.168 | [shaded] |
| GJ-3-5 | 1000 | [shaded] | 2.8132 | 0.0606 | 1.904 | 0.2602 | [shaded] |
| GJ-3-6 | 1001 | 0.0791 | 0.772 | 0.046 | 1.231 | 0.0677 | 1.7194 |
| GJ-3-7 | 1002 | 0.6065 | 1.8109 | 0.0927 | 1.621 | 0.0625 | [shaded] |
| GSJ-Int-FdF-1 | 1003 | [shaded] | 2.1439 | 0.0467 | 0.295 | [shaded] | [shaded] |
| GSJ-Int-FdF-2 | 1004 | [shaded] | 2.0912 | 0.0924 | 0.195 | [shaded] | [shaded] |
| GSJ-Int-FdF-3 | 1005 | [shaded] | 1.8727 | 0.0537 | 0.222 | [shaded] | [shaded] |
| GSJ-Int-FdF-4 | 1006 | 0.7215 | 1.0353 | 0.0522 | 0.095 | 0.6795 | 1.4721 |
| GSJ-Int-FdF-5 | 1007 | 1.3574 | 1.6888 | 0.0555 | 0.119 | 1.1065 | [shaded] |
| GSJ-Int-FdF-6 | 1008 | 0.7496 | 1.0469 | 0.052 | 0.081 | 0.6161 | 1.285 |
| GSJ-Int-FdF-7 | 1009 | 0.6324 | 0.7985 | 0.1179 | 0.15 | 0.5634 | 1.3309 |
| GSJ-Int-FdF-8 | 1010 | 1.4654 | 1.8779 | 0.0997 | 1.153 | 1.352 | [shaded] |
| GSJ-Int-FdF-9 | 1011 | 1.4669 | 1.8242 | 0.147 | 0.159 | 1.4619 | [shaded] |
| GSJ-Int-FdF-10 | 1012 | [shaded] | 2.0029 | 0.0532 | 0.624 | [shaded] | [shaded] |
| GSJ-Int-FdF-11 | 1013 | [shaded] | 1.8869 | 0.0512 | 0.173 | 1.3535 | [shaded] |

FIG. 69E

| | SEQ ID NO | (1) | (2) | (3) | (4) | (5) | (6) |
|---|---|---|---|---|---|---|---|
| GSJ-Int-FdF-12 | 1014 | | 2.0524 | 0.0676 | 0.714 | | |
| GSJ-Int-FdF-13 | 1015 | | 2.052 | 0.0534 | 0.894 | 1.4138 | |
| GSJ-Int-FdF-14 | 1016 | 1.2368 | 1.6639 | 0.0777 | 0.209 | 1.2947 | |
| GSJ-Int-FdF-15 | 1017 | | 2.0424 | 0.0531 | 0.18 | | |
| GSJ-Int-FdF-16 | 1018 | | 2.1147 | 0.0637 | 0.177 | | |
| IG1-V192M | 944 | 0.0622 | 0.1164 | 0.053 | 0.146 | 0.0632 | 0.3497 |
| IG2-A298M_RSVF(+)FdTHS-paH | 945 | | 3.0139 | 0.1081 | 2.686 | 0.3677 | |
| IG2-T58I_A298M | 946 | | 2.9796 | 0.0866 | 2.645 | | |
| IG2-T58I_V192F_A298I_RSVF(+)FdTHS-paH | 947 | 0.0912 | 0.0934 | 0.0992 | 0.127 | 0.0734 | 0.1541 |
| IG2-T58I_V192M_A298I_RSVF(+)FdTHS-paH | 948 | 0.0908 | 0.1119 | 0.0825 | 0.11 | 0.0832 | 0.7888 |
| i167m-a298m | 949 | 0.0995 | 0.3355 | 0.0492 | 0.345 | 0.0628 | 0.7184 |
| i167m-l181m | 950 | 0.0579 | 0.2538 | 0.052 | 0.367 | 0.0772 | 0.6506 |
| i199f | 951 | | 2.7464 | 0.4465 | 2.429 | 0.2993 | |
| i57c-s190c | 952 | 0.2652 | 0.5291 | 0.0661 | 0.094 | 0.0725 | 0.461 |
| ig2-t58i-a298m | 953 | 1.0703 | 1.5365 | 0.0717 | 0.552 | 0.1018 | 1.2219 |
| ig2-t58m | 954 | | 2.9985 | 0.1685 | 2.792 | 0.797 | |
| ig2-t58m-a298i | 955 | | 2.8545 | 0.056 | 2.765 | 0.8859 | |
| ig2-t58m-a298L | 956 | | 2.9793 | 0.0879 | 2.795 | | |
| ig2-v192c-ins192-193-g-e256c | 957 | 0.0696 | 0.1069 | 0.0556 | 0.11 | 0.0852 | 0.3724 |
| rsv_f_ths_s_f505w_o_s509f | 958 | 2.1277 | 2.6243 | 0.1037 | 1.738 | | |
| rsv_f_ths_s_f505w_s509f | 959 | 1.3529 | 1.6774 | 0.1193 | 0.158 | 1.4003 | |
| t58i-a298i | 960 | 2.6436 | 2.6535 | 0.0875 | 2.243 | 0.2619 | |
| t58m-a298m | 961 | 2.8387 | 2.715 | 0.1073 | 2.712 | | |
| v179l-t189f | 962 | 0.856 | 1.2011 | 0.0499 | 0.824 | 0.0621 | 0.9012 |
| v192f | 963 | 0.053 | 0.178 | 0.0816 | 0.186 | 0.0609 | 0.318 |
| v192f-l252a | 964 | 0.0515 | 0.0803 | 0.1396 | 0.074 | 0.0663 | 0.3239 |
| v56m-i167m-l181m | 965 | 0.0464 | 0.0855 | 0.062 | 0.071 | 0.0549 | 0.4488 |
| v56m-i167m-v296m | 966 | 0.0521 | 0.1116 | 0.0754 | 0.111 | 0.0518 | 0.4902 |
| v56m-l181f | 967 | 0.0511 | 0.1818 | 0.1008 | 0.475 | 0.0612 | 0.4797 |
| w52c-s150c | 968 | 0.1112 | 0.2253 | 0.0782 | 0.193 | 0.08 | 0.3329 |

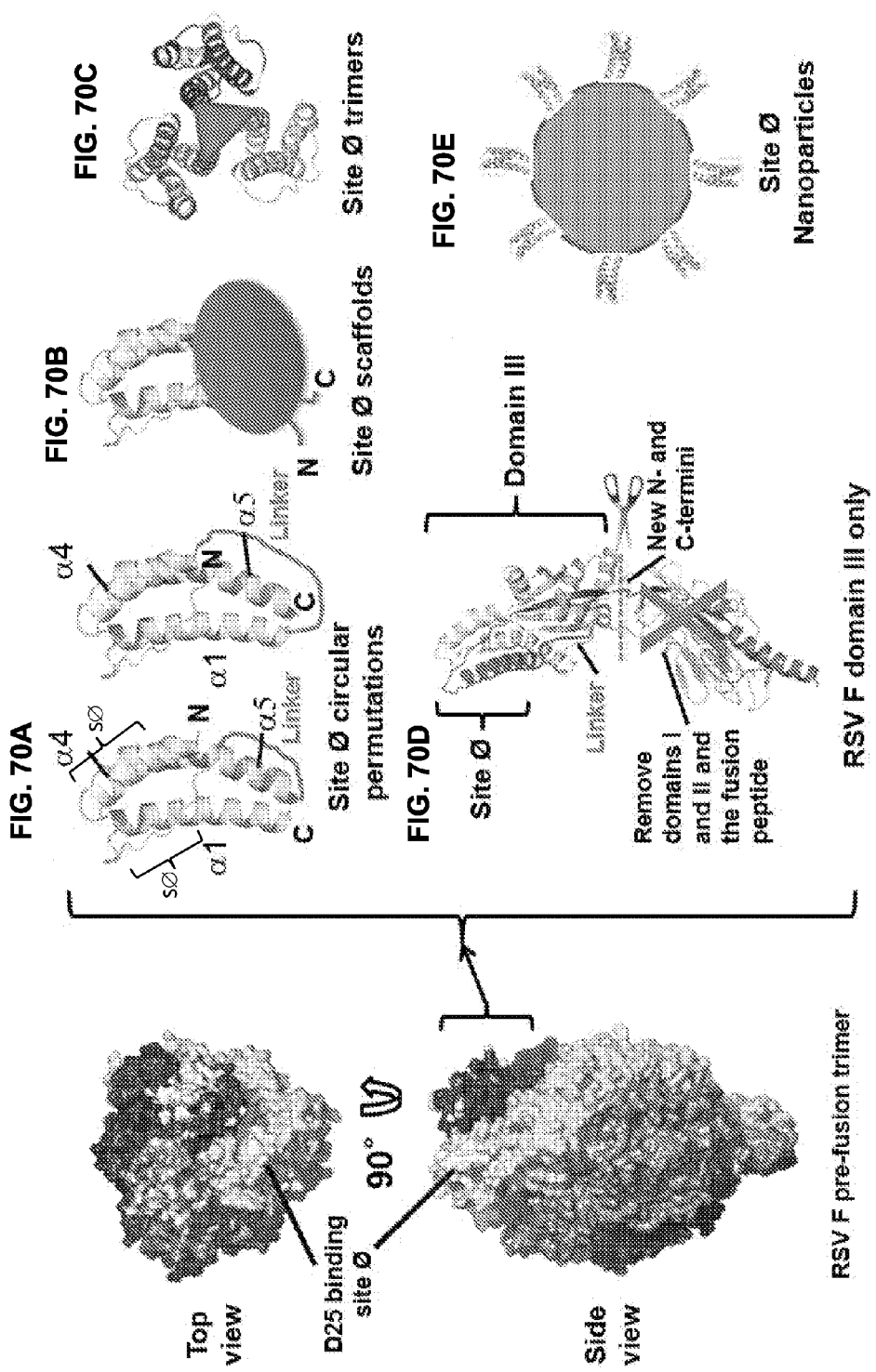

RSV F Antigenic Site Ø Immunogens

FIG. 71

- 249 immunogens expressed and evaluated antigenically:

26 Circularly permutated site Ø monomers
  25 Circularly permutated scaffolded site Ø monomers
  39 Trimerized circularly permutated site Ø
  11 Circularly permutated site Ø monomer nanoparticles
  1 Circularly permutated site Ø trimer on ferritin nanoparticles
  52 Domain III constructs
  12 Trimerized domain III constructs
  18 Circularly permutated domain III dimers
  10 Circularly permutated trimerized domain III dimers
  51 Domain III on nanoparticles
  4  Trimerized domain III nanoparticles

- Antigenic readout

D25 binding at 0 and 1 week at 4°C
  D25 binding after 1 hr. at 60°C, 70°C, 80°C, 90°C and 100°C
  AM22 and 5C4 binding

- Summary of antigenicity results (ELISA ≥ 1.5):

| Immunogens designed | D25 wk 0 4C | D25 wk 1 4C | D25 1hr 60C | D25 1hr 70C | D25 1hr 80C | D25 1hr 90C | D25 1 hr 100C | AM22 wk2 4C | 5C4 wk 0 4C |
|---|---|---|---|---|---|---|---|---|---|
| Monomers (121) | 54 | 49 | 45 | 49 | 21 | 9 | 10 | 54 | 44 |
| Trimers (61) | 36 | 31 | 40 | 28 | 13 | 4 | 6 | 42 | 42 |
| Monomers on nanoparticles (63) | 20 | 12 | 20 | 12 | 0 | 0 | 0 | 28 | 23 |
| Trimers on nanoparticles (4) | 0 | 2 | 1 | 2 | 0 | 0 | 0 | 4 | 4 |

FIG. 72A

| SEQ ID NO | (1) | (2) | (3) | (4) | (5) | (6) | (7) | (8) | (9) | (10) |
|---|---|---|---|---|---|---|---|---|---|---|
| Con | 1.7749 | ▓ | 1.3312 | 0.063 | 0.0546 | 0.0611 | ND | ▓ | ▓ | ▓ |
| Con | ▓ | 0.1536 | 0.1846 | 0.051 | 0.0596 | 0.0907 | ND | 0.915 | ND | 0.373 |
| Circular permutation of site 0 (26) | | | | | | | | | | |
| 1027 | 0.994 | 0.7916 | 0.4133 | ▓ | 1.2895 | 0.7806 | ND | 0.3243 | 0.1245 | 1.305 |
| 1028 | 0.2347 | 0.1646 | 0.0961 | ▓ | ▓ | 0.7053 | ND | 0.4055 | 0.0814 | 0.693 |
| 1029 | 0.0597 | 0.0619 | 0.0531 | 0.055 | 0.0652 | 0.0583 | ND | 0.1138 | 0.0892 | 0.077 |
| 1030 | 1.0318 | 0.6279 | 0.4113 | 0.959 | ▓ | 0.4427 | ND | 1.1626 | 0.0856 | 0.916 |
| 1031 | 0.3199 | 0.3181 | 0.1695 | ▓ | ▓ | 1.4001 | ▓ | 0.8191 | 0.0751 | 1.272 |
| 1032 | 0.0661 | 0.0616 | 0.0562 | 0.067 | 0.0791 | 0.065 | ND | 0.1363 | 0.0932 | 0.088 |
| 1033 | 1.3594 | 0.849 | 0.4444 | ▓ | ▓ | ▓ | ▓ | 0.2756 | 0.0867 | 1.279 |
| 1034 | 0.5424 | 0.6069 | 0.1407 | ▓ | ▓ | 1.5628 | ▓ | 0.1339 | 0.0842 | 1.035 |
| 1035 | 0.071 | 0.0661 | 0.0564 | 0.076 | 0.084 | 0.1459 | ND | 0.0943 | 0.1136 | 0.079 |
| 1036 | ▓ | ▓ | 1.5353 | ▓ | ▓ | 0.1381 | ND | ▓ | 0.075 | ▓ |
| 1037 | ▓ | 1.4036 | 1.4876 | 0.434 | 0.3958 | 0.4036 | ND | ▓ | 0.1077 | 1.297 |
| 1038 | ▓ | ▓ | 1.376 | 0.629 | 0.0524 | 0.333 | ND | ▓ | 0.0858 | 1.501 |
| 1039 | ▓ | ▓ | ▓ | ▓ | 0.2338 | 0.2418 | ND | ▓ | 0.1113 | ▓ |
| 1040 | ▓ | ▓ | ▓ | ▓ | 0.0559 | ▓ | ▓ | ▓ | 0.0604 | ▓ |
| 1041 | ▓ | ▓ | ▓ | ▓ | 0.4102 | 0.8312 | ▓ | ▓ | 0.0613 | ▓ |
| 1042 | 0.0777 | 0.071 | 0.085 | 0.052 | 0.0859 | 0.0496 | ND | 0.2679 | 0.0933 | 0.130 |
| 1043 | 0.0564 | 0.0648 | 0.0617 | 0.051 | 0.0819 | 0.0485 | ND | 0.1483 | 0.187 | 0.088 |
| 1044 | 0.053 | 0.0523 | 0.0574 | 0.049 | 0.0847 | 0.0498 | ND | 0.0832 | 0.1699 | 0.061 |
| 1045 | 0.0491 | 0.0571 | 0.0561 | 0.046 | 0.074 | 0.0468 | ND | 0.1178 | 0.2204 | 0.074 |
| 1046 | 0.0719 | 0.1451 | 0.218 | 0.145 | ▓ | ▓ | ND | ▓ | ▓ | 0.889 |
| 1047 | 0.0786 | 0.0507 | 0.2224 | 0.051 | 0.1093 | 0.4426 | ND | 1.1171 | 0.9184 | 0.406 |
| 1048 | 0.0855 | 0.2682 | 0.0826 | 0.268 | ▓ | ▓ | ND | ▓ | 0.1436 | 0.895 |
| 1049 | 0.856 | ▓ | 0.2993 | ▓ | ▓ | ▓ | ▓ | 0.3899 | 0.1003 | ▓ |
| 1050 | 0.0607 | 0.4221 | 0.1522 | 0.422 | 0.6564 | ▓ | ND | 0.2904 | 0.1102 | 0.378 |
| 1051 | 0.1055 | ▓ | 0.1805 | ▓ | ▓ | ▓ | ▓ | 0.4197 | 0.1127 | 1.466 |
| 1052 | ▓ | ▓ | ▓ | ▓ | ▓ | ▓ | ▓ | ▓ | ▓ | ▓ |
| Circular permutation with scaffold connection (19) | | | | | | | | | | |
| 1053 | ▓ | ▓ | ▓ | ▓ | ▓ | ▓ | ▓ | ▓ | ▓ | ▓ |
| 1054 | 0.0728 | 0.0849 | 0.0929 | 0.063 | 0.0677 | 0.0465 | ND | 0.3494 | 0.0902 | 0.166 |
| 1055 | 0.5403 | 0.3211 | 0.3096 | 0.249 | 0.1933 | 0.0526 | ND | 1.0104 | 0.1344 | 0.527 |
| 1056 | ▓ | ▓ | ▓ | 0.304 | 0.1792 | 0.0586 | ND | ▓ | 0.0816 | 1.335 |
| 1057 | 0.7436 | 0.3687 | 0.4128 | 0.083 | 0.085 | 0.0479 | ND | 0.4357 | 0.0715 | 0.296 |
| 1058 | 0.0633 | 0.0816 | 0.06 | 0.058 | 0.085 | 0.0521 | ND | 0.1304 | 0.0744 | 0.090 |
| 1059 | 0.0641 | 0.065 | 0.0717 | 0.054 | 0.0648 | 0.0546 | ND | 0.2744 | 0.1045 | 0.131 |
| 1060 | ▓ | ▓ | ▓ | 1.006 | 0.0925 | 0.0498 | ND | ▓ | ▓ | ▓ |
| 1061 | 0.0754 | 0.0712 | 0.0716 | 0.058 | 0.0682 | 0.0505 | ND | 0.2135 | 0.1304 | 0.114 |
| 1062 | 0.4145 | 0.1479 | 0.1602 | 0.133 | 0.1876 | 0.0542 | ND | 0.5636 | 0.1938 | 0.281 |
| 1063 | 0.085 | 0.0982 | 0.0661 | 0.069 | 0.0828 | 0.0496 | ND | 0.343 | 0.0841 | 0.170 |
| 1064 | 0.0541 | 0.0569 | 0.0632 | 0.052 | 0.1114 | 0.0567 | ND | 0.105 | 0.0799 | 0.071 |
| 1065 | 0.0562 | 0.214 | 0.0571 | 0.06 | 0.0848 | 0.0641 | ND | 0.1566 | 0.0759 | 0.144 |
| 1066 | 0.0676 | 0.0694 | 0.0521 | 0.061 | 0.1022 | 0.0507 | ND | 0.09 | 0.0813 | 0.073 |
| 1067 | 0.0492 | 0.0514 | 0.0566 | 0.049 | 0.0677 | 0.0552 | ND | 0.1413 | 0.0937 | 0.080 |
| 1068 | ▓ | ▓ | ▓ | ▓ | 0.2665 | 0.082 | ND | ▓ | ▓ | ▓ |
| 1069 | 0.07 | 0.0696 | 0.0656 | 0.054 | 0.0758 | 0.0499 | ND | 0.2169 | 0.1646 | 0.113 |
| 1070 | 0.0523 | 0.0527 | 0.0546 | 0.05 | 0.079 | 0.0473 | ND | 0.1313 | 0.1131 | 0.078 |
| 1071 | 0.0448 | 0.0484 | 0.0913 | 0.046 | 0.0703 | 0.049 | ND | 0.1503 | 0.0733 | 0.082 |

FIG. 72B

| SEQ ID NO | (1) | (2) | (3) | (4) | (5) | (6) | (7) | (8) | (9) | (10) |
|---|---|---|---|---|---|---|---|---|---|---|
| Circular permutation of site 0 with trimer (39) ||||||||||
| 1072 | 0.3581 | 0.4078 | 0.7423 | 0.481 | 1.1851 | 1.6631 | ND | 0.3298 | 0.0868 | 0.406 |
| 1073 | ▨ | ▨ | ▨ | 1.327 | ▨ | ▨ | ▨ | 1.1248 | 0.0861 | 1.434 |
| 1074 | 0.1814 | 0.2503 | 0.3292 | 0.114 | 0.2837 | 0.1077 | ND | 0.2319 | 0.0806 | 0.199 |
| 1075 | ▨ | ▨ | ▨ | 2.791 | ▨ | ▨ | ▨ | 0.4305 | 0.0997 | ▨ |
| 1076 | ▨ | 1.3076 | ▨ | 1.305 | ▨ | 1.4035 | ▨ | 0.1298 | 0.0862 | 0.914 |
| 1077 | 1.472 | 0.825 | ▨ | 1.15 | ▨ | 0.5228 | ND | 0.2167 | 0.0854 | 0.731 |
| 1078 | 0.8158 | 0.2163 | 0.8631 | 0.306 | ▨ | 1.2613 | ND | 0.099 | 0.0767 | 0.207 |
| 1079 | 1.7333 | ▨ | ▨ | 1.409 | ▨ | ▨ | ▨ | 1.4647 | 0.107 | 1.472 |
| 1080 | 0.4502 | 0.2953 | 0.4333 | 0.187 | 0.3934 | 0.1679 | ND | 0.218 | 0.0819 | 0.233 |
| 1081 | ▨ | ▨ | ▨ | ▨ | ▨ | ▨ | ▨ | 0.3779 | 0.1206 | ▨ |
| 1082 | 0.3473 | 0.3027 | 0.5607 | 0.371 | 0.8177 | 0.4034 | ND | 0.0757 | 0.0815 | 0.250 |
| 1083 | 0.4663 | 0.2718 | 0.8992 | 0.42 | 0.9627 | 0.2882 | ND | 0.0854 | 0.079 | 0.259 |
| 1084 | 0.3509 | 0.363 | 0.2706 | 0.519 | 0.4042 | 0.0582 | ND | 1.3032 | 0.0717 | 0.728 |
| 1085 | 0.1433 | 0.1191 | 0.2362 | 0.365 | 0.3129 | 0.0557 | ND | 0.9482 | 0.1128 | 0.477 |
| 1086 | 0.3671 | 0.2472 | 0.5002 | 0.551 | 0.4468 | 0.0653 | ND | ▨ | 0.0853 | 0.813 |
| 1087 | 0.0741 | 0.0731 | 0.0846 | 0.11 | 0.1371 | 0.0512 | ND | 0.263 | 0.1618 | 0.149 |
| 1088 | ▨ | ▨ | ▨ | ▨ | ▨ | 0.2414 | ND | ▨ | 0.0775 | ▨ |
| 1099 | 1.6689 | 0.8883 | 1.2592 | 1.073 | 1.3876 | 0.1011 | ND | ▨ | 0.078 | 1.171 |
| 1100 | 1.1362 | 0.5942 | 0.7754 | 0.682 | 0.9898 | 0.0765 | ND | ▨ | 0.0844 | 1.109 |
| 1101 | ▨ | ▨ | 1.6158 | ▨ | ▨ | 0.1205 | ND | ▨ | 0.0928 | ▨ |
| 1102 | ▨ | ▨ | ▨ | ▨ | ▨ | 0.0829 | ND | ▨ | 0.0746 | ▨ |
| 1103 | ▨ | ▨ | ▨ | ▨ | 0.1093 | 0.0562 | ND | ▨ | 0.0686 | ▨ |
| 1104 | ▨ | ▨ | ▨ | ▨ | ▨ | 0.0737 | ND | ▨ | 0.0638 | ▨ |
| 1105 | ▨ | ▨ | ▨ | 0.969 | 0.0737 | 0.0519 | ND | ▨ | 0.1038 | ▨ |
| 1106 | ▨ | ▨ | ▨ | ▨ | 1.4528 | 0.0601 | ND | ▨ | 0.0849 | ▨ |
| 1107 | ▨ | ▨ | ▨ | ▨ | 0.5496 | 0.0541 | ND | ▨ | 0.1179 | ▨ |
| 1108 | 0.0592 | 0.057 | 0.0537 | 0.057 | 0.0462 | 0.1491 | ND | 0.6247 | 0.1318 | 0.246 |
| 1109 | 0.0814 | 0.0709 | 0.0718 | 0.071 | 0.1027 | 0.5605 | ND | 0.464 | 0.1334 | 0.202 |
| 1110 | 0.0477 | 0.0615 | 0.0575 | 0.062 | 0.1888 | 0.1249 | ND | 0.5142 | 0.1537 | 0.212 |
| 1111 | 0.051 | 0.0559 | 0.0564 | 0.056 | 0.0935 | 0.2652 | ND | 0.6155 | 0.1604 | 0.242 |
| 1112 | 0.0533 | 0.0513 | 0.0547 | 0.051 | 0.0655 | 0.1411 | ND | 0.5763 | 0.1488 | 0.226 |
| 1113 | 0.0713 | 0.0623 | 0.0659 | 0.062 | 0.1656 | 0.2525 | ND | 0.5906 | 0.1695 | 0.238 |
| 1114 | 0.0546 | 0.0528 | 0.1484 | 0.053 | 0.0823 | 0.7941 | ND | 0.7087 | 0.1844 | 0.271 |
| 1115 | 0.1118 | 0.0548 | 0.1034 | 0.055 | 0.0533 | 1.0703 | ND | ▨ | 0.1999 | 0.700 |
| 1116 | ▨ | ▨ | ▨ | ▨ | 0.5106 | 0.0828 | ND | ▨ | ▨ | ▨ |
| 1117 | 0.0632 | 0.0606 | 0.0677 | 0.061 | 0.0582 | 0.2678 | ND | 0.523 | 0.1354 | 0.215 |
| 1118 | 0.0821 | 0.1203 | 0.11 | 0.12 | 0.0819 | 0.091 | ND | 0.4687 | 0.109 | 0.236 |
| 1119 | 0.0581 | 0.0587 | 0.0563 | 0.059 | 0.0614 | 0.0524 | ND | 0.2851 | 0.1118 | 0.134 |
| 1120 | 0.0555 | 0.0518 | 0.0592 | 0.052 | 0.0595 | 0.0498 | ND | 0.2154 | 0.1156 | 0.106 |
| Site 0 minimal epitope on a scaffold (6) ||||||||||
| 1121 | 0.0588 | 0.0565 | 0.0558 | 0.057 | 0.1035 | 0.0593 | ND | 0.2015 | 0.0825 | 0.105 |
| 1122 | 0.0567 | 0.0579 | 0.0597 | 0.058 | 0.0997 | 0.0629 | ND | 0.1782 | 0.1011 | 0.098 |
| 1123 | 0.0535 | 0.0527 | 0.1198 | 0.053 | 0.1266 | 0.0767 | ND | 0.1795 | 0.1359 | 0.095 |
| 1124 | 0.0547 | 0.1717 | 0.6951 | 0.172 | 0.0968 | 0.054 | ND | 1.0895 | 1.644 | 0.478 |
| 1125 | 0.0498 | 0.0523 | 0.0699 | 0.048 | 0.0803 | 0.0618 | ND | 0.623 | 0.1274 | 0.241 |
| 1126 | 0.0467 | 0.0511 | 0.0507 | 0.055 | 0.0846 | 0.0602 | ND | 0.1205 | 0.1162 | 0.075 |
| Domain III (42) ||||||||||
| 1127 | ▨ | ▨ | ND | ▨ | ND | ND | ND | ND | ND | ND |

FIG. 72C

| SEQ ID NO | (1) | (2) | (3) | (4) | (5) | (6) | (7) | (8) | (9) | (10) |
|---|---|---|---|---|---|---|---|---|---|---|
| 1128 | | 1.3526 | ND | 0.182 | ND | ND | ND | ND | ND | ND |
| 1129 | 0.1181 | 0.1009 | ND | 0.067 | ND | ND | ND | ND | ND | ND |
| 1130 | | | ND | 0.568 | ND | ND | ND | ND | ND | ND |
| 1131 | | 0.9357 | ND | 0.208 | ND | ND | ND | ND | ND | ND |
| 1132 | 0.1072 | 0.1636 | ND | 0.075 | ND | ND | ND | ND | ND | ND |
| 1133 | | | ND | | ND | ND | ND | ND | ND | ND |
| 1134 | | 1.3663 | ND | 0.25 | ND | ND | ND | ND | ND | ND |
| 1135 | 0.2983 | 0.2993 | ND | 0.11 | ND | ND | ND | ND | ND | ND |
| 1136 | | | ND | | ND | ND | ND | ND | ND | ND |
| 1137 | 0.9978 | 1.1904 | ND | 0.28 | ND | ND | ND | ND | ND | ND |
| 1138 | 0.5312 | 0.7704 | ND | 0.305 | ND | ND | ND | ND | ND | ND |
| 1139 | | | | | 0.1128 | 0.0592 | ND | | | |
| 1140 | 0.1182 | 0.2949 | 0.1563 | 0.094 | 0.0826 | 0.0517 | ND | 1.2182 | 1.5279 | 0.536 |
| 1141 | | | | | 0.2226 | 0.0622 | ND | | | |
| 1142 | | | | | 0.2683 | 0.0536 | ND | | | |
| 1143 | | | | | 0.8527 | 0.224 | ND | | | |
| 1144 | | | | | 0.3977 | 0.1391 | ND | | | |
| 1145 | | | | | | 0.0521 | ND | | | |
| 1146 | | | | | 1.0453 | 0.1286 | ND | | | |
| 1147 | | | | | | 1.13 | | | | |
| 1148 | | | | | 0.7371 | 0.3829 | ND | 1.4542 | | |
| 1149 | | | | | 0.5153 | 0.2845 | ND | | | |
| 1150 | | | | | 0.4836 | 0.075 | ND | | | |
| 1151 | | | | | 0.9838 | 0.0662 | ND | | | |
| 1152 | | | | | 1.4915 | 0.0614 | ND | | | |
| 1153 | | | | | 0.8313 | 0.2322 | ND | | | |
| 1154 | | | | | 1.2956 | 0.224 | ND | | | |
| 1155 | | | | | | 0.2005 | ND | | | |
| 1156 | | | | | | 0.7406 | ND | | | |
| 1157 | | | | | 1.0701 | 0.1974 | ND | | | |
| 1158 | | 1.0186 | 0.9501 | 0.208 | 0.3739 | 0.0864 | ND | | | 1.344 |
| 1159 | | | | | | 0.1447 | ND | | | |
| 1160 | | | | 0.076 | | 0.1097 | ND | | | |
| 1161 | | | | | | 0.8036 | ND | | | |
| 1162 | | | | | | 0.1987 | ND | | | |
| 1163 | | | | | 1.3027 | 0.2541 | ND | | | |
| 1164 | 0.5076 | | | | | 0.1256 | ND | | | |
| 1165 | | 1.285 | | 1.285 | 0.0445 | 0.0903 | ND | | | |
| 1166 | | | | | 0.1207 | 0.0893 | ND | | | |
| 1167 | | | | | 0.0664 | 0.0703 | ND | | | |
| 1168 | | | | | 0.1674 | 0.0705 | ND | | | |
| Domain III with trimer (22) | | | | | | | | | | |
| 1169 | | | | | 1.0033 | 0.1147 | ND | | | |
| 1170 | | | | | 1.3358 | 0.4711 | ND | | | |
| 1171 | | | | | | 1.3086 | | | | |
| 1172 | | | | | 0.7138 | 0.1834 | ND | | | |
| 1173 | | | | | 1.2007 | 0.1174 | ND | | | |
| 1174 | | | | | 0.4101 | 0.0565 | ND | 0.8609 | | |
| 1175 | | | | | 0.3803 | 0.0639 | ND | 1.2822 | | |
| 1176 | | | | | 0.4938 | 0.1352 | ND | | | |

FIG. 72D

| SEQ ID NO | (1) | (2) | (3) | (4) | (5) | (6) | (7) | (8) | (9) | (10) |
|---|---|---|---|---|---|---|---|---|---|---|
| 1177 | | | | | 0.2782 | 0.0624 | ND | | | |
| 1178 | | | | | | 0.0711 | ND | | | |
| 1179 | | 0.0982 | | 0.098 | 0.0688 | 0.0638 | ND | | | 1.057 |
| 1180 | | | | | 0.1038 | 0.0698 | ND | | | |
| 1181 | | 1.392 | | 1.392 | 0.2403 | 0.1386 | ND | | | |
| 1182 | | 1.3382 | | 1.338 | 0.2278 | 0.1296 | ND | | | |
| 1183 | | | | | 0.0668 | 0.0524 | ND | | | |
| 1184 | 0.0549 | 0.0533 | 0.0805 | 0.053 | 0.0519 | 0.0585 | ND | 0.7682 | 0.3922 | 0.292 |
| 1185 | | | | | 0.1002 | 0.0551 | ND | | | |
| 1186 | | 1.4644 | | 1.464 | 0.2314 | 0.1102 | ND | | | |
| 1187 | | | | | 0.2269 | 0.1206 | ND | | | |
| 1188 | | | | | 0.1278 | 0.0592 | ND | | | |
| 1189 | | | | | 0.1162 | 0.0614 | ND | | | |
| 1190 | 0.4011 | 0.1884 | 0.7964 | 0.188 | 0.0616 | 0.0521 | ND | | | 0.917 |
| Tandem domain III (18) | | | | | | | | | | |
| 1191 | | 0.8202 | | 0.82 | 0.0574 | 0.0618 | ND | | | 1.497 |
| 1192 | | | | | 0.0691 | 0.0734 | ND | | | |
| 1193 | | | | | 0.0583 | 0.0726 | ND | | | |
| 1194 | | | | | 0.1009 | 0.066 | ND | | | |
| 1195 | 1.5986 | 1.0687 | | 1.069 | 0.0794 | 0.0514 | ND | | | |
| 1196 | | | | | 0.0762 | 0.0593 | ND | | | |
| 1197 | | | | | 0.0576 | 0.0473 | ND | | | |
| 1198 | | | | | 0.1422 | 0.0503 | ND | | | |
| 1199 | 0.0522 | 0.0518 | 0.0592 | 0.052 | 0.053 | 0.0455 | ND | 0.4433 | 0.1375 | 0.182 |
| 1200 | | 0.5879 | | 0.588 | 0.2308 | 0.0942 | ND | | | 1.292 |
| 1201 | 0.0699 | 0.0527 | 0.0626 | 0.053 | 0.0475 | 0.0547 | ND | 0.2363 | 0.1469 | 0.114 |
| 1202 | 0.5592 | 0.1981 | 1.4615 | 0.198 | 0.0562 | 0.051 | ND | | | 0.974 |
| 1203 | 0.0815 | 0.0506 | 0.0973 | 0.051 | 0.04 | 0.0528 | ND | 0.301 | 0.2133 | 0.134 |
| 1204 | 0.1143 | 0.7387 | 0.3154 | 0.739 | 0.3958 | 0.0577 | ND | | 1.2797 | 1.198 |
| 1205 | 0.0526 | 0.049 | 0.1158 | 0.049 | 0.0524 | 0.0464 | ND | 0.1603 | 0.1179 | 0.086 |
| 1206 | 0.0978 | 0.6093 | 0.1909 | 0.609 | 0.2338 | 0.0493 | ND | | 0.9296 | 0.923 |
| 1207 | 0.0591 | 0.052 | 0.0893 | 0.052 | 0.0559 | 0.0465 | ND | 0.3483 | 0.1432 | 0.151 |
| 1208 | 0.1188 | 0.5431 | 0.2391 | 0.543 | 0.4102 | 0.0467 | ND | | 1.5241 | 0.997 |
| Tandem domain III with a trimer (10) | | | | | | | | | | |
| 1209 | 0.6093 | 0.0806 | 0.8155 | 0.081 | 0.0438 | 0.0938 | ND | | | 0.954 |
| 1210 | 1.3484 | | | | 0.0624 | 0.0769 | ND | | | |
| 1211 | 1.2145 | 0.7313 | | 0.731 | 0.0648 | 0.0658 | ND | | | 1.471 |
| 1212 | | | | | 0.0758 | 0.065 | ND | | | |
| 1213 | | 0.8101 | | 0.81 | 0.0712 | 0.0731 | ND | | | 1.526 |
| 1214 | | 1.4694 | | 0.056 | 0.0612 | 0.049 | ND | | | 1.412 |
| 1215 | 0.2802 | 0.0612 | 0.346 | 0.061 | 0.0687 | 0.046 | ND | | | 0.845 |
| 1216 | 0.4552 | 0.1039 | 0.9587 | 0.104 | 0.0634 | 0.0464 | ND | | | 0.904 |
| 1217 | 0.264 | 0.065 | | 0.065 | 0.0577 | 0.0622 | ND | | | 0.791 |
| 1218 | 0.4957 | 0.1884 | 0.8309 | 0.188 | 0.0491 | 0.0521 | ND | | | 0.956 |

FIG. 72E

| SEQ ID NO | (1) | (2) | (3) | (4) | (5) | (6) | (7) | (8) | (9) | (10) |
|---|---|---|---|---|---|---|---|---|---|---|
|  | 1.7749 | [shaded] | 1.331 | 0.0628 | 0.0546 | 0.0611 | ND | [shaded] | [shaded] | [shaded] |
|  | [shaded] | 0.1536 | 0.185 | 0.051 | 0.0596 | 0.0907 | ND | 0.915 | ND | 0.373 |
| Domain III on ferritin (45) ||||||||||| 
| 1219 | [shaded] | [shaded] | [shaded] | [shaded] | 0.065 | 0.0473 | ND | [shaded] | [shaded] | [shaded] |
| 1220 | [shaded] | [shaded] | [shaded] | [shaded] | 0.3082 | 0.0755 | ND | [shaded] | [shaded] | [shaded] |
| 1221 | [shaded] | [shaded] | [shaded] | [shaded] | 0.1323 | 0.0531 | ND | [shaded] | [shaded] | [shaded] |
| 1222 | [shaded] | [shaded] | 2.541 | [shaded] | 0.2636 | 0.0577 | ND | [shaded] | [shaded] | [shaded] |
| 1223 | 0.0612 | 0.0736 | 0.061 | 0.0736 | 0.0735 | 0.0813 | ND | 0.7882 | 0.1386 | 0.3118 |
| 1224 | 0.0565 | 0.0708 | 0.052 | 0.0708 | 0.0824 | 0.1425 | ND | 0.6484 | 0.1213 | 0.2633 |
| 1225 | 0.0694 | 0.0861 | 0.064 | 0.0861 | 0.0815 | 0.0829 | ND | 0.7931 | 0.1601 | 0.3218 |
| 1226 | 0.0584 | 0.0614 | 0.061 | 0.0614 | 0.0698 | 0.108 | ND | 0.8759 | 0.1194 | 0.3329 |
| 1227 | 0.055 | 0.0566 | 0.057 | 0.0566 | 0.0655 | 0.0654 | ND | 0.6022 | 0.1469 | 0.2385 |
| 1228 | 0.0546 | 0.0591 | 0.052 | 0.0591 | 0.062 | 0.1387 | ND | 0.3552 | 0.1366 | 0.1578 |
| 1229 | 0.1014 | 0.1232 | 0.144 | 0.1232 | 0.0653 | 0.0543 | ND | [shaded] | 0.5376 | 0.6011 |
| 1230 | 0.1051 | 0.1351 | 0.105 | 0.1351 | 0.059 | 0.0605 | ND | 1.1219 | 0.2913 | 0.4640 |
| 1231 | 0.0566 | 0.057 | 0.058 | 0.057 | 0.0745 | 0.1529 | ND | 0.6168 | 0.1501 | 0.2436 |
| 1232 | 0.056 | 0.061 | 0.066 | 0.061 | 0.076 | 0.1061 | ND | 0.5295 | 0.1523 | 0.2172 |
| 1233 | 0.0722 | 0.0668 | 0.063 | 0.0668 | 0.0734 | 0.0919 | ND | 0.8361 | 0.2903 | 0.3232 |
| 1234 | 0.0856 | 0.0682 | 0.086 | 0.0682 | 0.0703 | 0.0575 | ND | 1.164 | 0.3927 | 0.4335 |
| 1235 | 0.0565 | 0.0688 | 0.058 | 0.0688 | 0.0713 | 0.0547 | ND | 0.648 | 0.2045 | 0.2619 |
| 1236 | 0.0905 | 0.0981 | 0.1 | 0.0981 | 0.0712 | 0.1001 | ND | 1.4816 | 0.4691 | 0.5593 |
| 1237 | 0.1075 | 0.1501 | 0.14 | 0.1501 | 0.0741 | 0.0547 | ND | [shaded] | 0.5662 | 0.6026 |
| 1238 | 0.1118 | 0.1694 | 0.13 | 0.1694 | 0.0762 | 0.0534 | ND | 1.5024 | 0.5431 | 0.6137 |
| 1239 | 0.0961 | 0.0877 | 0.115 | 0.0877 | 0.0755 | 0.051 | ND | 1.4138 | 0.5617 | 0.5297 |
| 1240 | 0.074 | 0.0465 | 0.048 | 0.0465 | 0.0672 | 0.0468 | ND | 0.7411 | 0.2309 | 0.2780 |
| 1241 | 0.0637 | 0.0613 | 0.054 | 0.0613 | 0.0706 | 0.0534 | ND | 0.5896 | 0.2442 | 0.2374 |
| 1242 | 0.0801 | 0.0551 | 0.066 | 0.0551 | 0.0687 | 0.0501 | ND | 1.185 | 0.3432 | 0.4317 |
| 1243 | 0.0489 | 0.0743 | 0.052 | 0.0743 | 0.0702 | 0.0585 | ND | 0.4026 | 0.1753 | 0.1837 |
| 1244 | 0.0658 | 0.0898 | 0.088 | 0.0898 | 0.0849 | 0.0886 | ND | 1.1825 | 0.3517 | 0.4540 |
| 1245 | 0.0437 | 0.0525 | 0.05 | 0.0525 | 0.0899 | 0.0621 | ND | 0.354 | 0.198 | 0.1530 |
| 1246 | 0.0915 | 0.1202 | 0.121 | 0.1202 | 0.0835 | 0.0683 | ND | 1.4024 | 0.5728 | 0.5476 |
| 1247 | 0.0519 | 0.054 | 0.053 | 0.054 | 0.0869 | 0.056 | ND | 0.3511 | 0.2163 | 0.1530 |
| 1248 | 0.0538 | 0.0529 | 0.05 | 0.0529 | 0.085 | 0.0533 | ND | 0.6254 | 0.2197 | 0.2437 |
| 1249 | 0.054 | 0.0604 | 0.071 | 0.0604 | 0.0727 | 0.0638 | ND | 0.2686 | 0.1958 | 0.1298 |
| 1250 | 0.0498 | 0.052 | 0.05 | 0.052 | 0.0783 | 0.061 | ND | 0.4175 | 0.2043 | 0.1738 |
| 1251 | 0.7164 | 0.0893 | 1.281 | 0.0893 | 0.1008 | 0.0816 | ND | [shaded] | [shaded] | 0.9395 |
| 1252 | 0.4948 | 0.0911 | 1.178 | 0.0911 | 0.328 | 0.1121 | ND | [shaded] | [shaded] | 0.9321 |
| 1253 | [shaded] | [shaded] | [shaded] | [shaded] | 0.0885 | 0.1008 | ND | [shaded] | [shaded] | [shaded] |
| 1254 | [shaded] | [shaded] | [shaded] | [shaded] | 0.0897 | 0.0923 | ND | [shaded] | [shaded] | [shaded] |
| 1255 | [shaded] | [shaded] | [shaded] | [shaded] | 0.0871 | 0.0778 | ND | [shaded] | [shaded] | [shaded] |
| 1256 | [shaded] | 1.2219 | [shaded] | 1.2219 | 0.0949 | 0.0832 | ND | [shaded] | [shaded] | [shaded] |
| 1257 | [shaded] | 0.5965 | [shaded] | 0.5965 | 0.1684 | 0.1345 | ND | [shaded] | [shaded] | 1.3527 |
| 1258 | [shaded] | 0.7303 | [shaded] | 0.7303 | 0.0687 | 0.0793 | ND | [shaded] | [shaded] | 1.4432 |
| 1259 | [shaded] | 0.9592 | [shaded] | 0.9592 | 0.0654 | 0.0825 | ND | [shaded] | [shaded] | [shaded] |
| 1260 | 0.0859 | 0.0482 | 0.068 | 0.0482 | 0.0762 | 0.1101 | ND | [shaded] | 0.4392 | 0.5552 |
| 1261 | 0.0694 | 0.0545 | 0.075 | 0.0545 | 0.0549 | 0.0839 | ND | [shaded] | 0.4449 | 0.6575 |
| 1262 | [shaded] | [shaded] | [shaded] | [shaded] | 0.6392 | 0.084 | ND | [shaded] | [shaded] | [shaded] |
| 1263 | [shaded] | [shaded] | [shaded] | [shaded] | 0.845 | 0.1029 | ND | [shaded] | [shaded] | [shaded] |

FIG. 72F

| SEQ ID NO | (1) | (2) | (3) | (4) | (5) | (6) | (7) | (8) | (9) | (10) |
|---|---|---|---|---|---|---|---|---|---|---|
| Minimal epitope with trimer on ferritin (1) | | | | | | | | | | |
| 1264 | 0.0742 | 0.0546 | 0.069 | 0.0546 | 0.0842 | 0.2906 | ND | 0.5426 | 0.161 | 0.2173 |
| Domain III with trimer on ferritin (4) | | | | | | | | | | |
| 1265 | 0.5925 | 0.1983 | 0.864 | 0.1983 | 0.047 | 0.0535 | ND | | | 0.9442 |
| 1266 | 1.6402 | | | | 0.097 | 0.0591 | ND | | | |
| 1267 | 0.8118 | 0.6634 | 1.349 | 0.6634 | 0.0617 | 0.0524 | ND | | | 1.2646 |
| 1268 | 0.9489 | | 1.533 | | 0.0972 | 0.0509 | ND | | | |
| Minimal epitope on LS (2) | | | | | | | | | | |
| 1269 | 0.0636 | 0.0609 | 0.087 | 0.0609 | 0.0805 | 0.1106 | ND | 0.5099 | 0.1762 | 0.2106 |
| 1270 | 0.0575 | 0.0568 | 0.078 | 0.0568 | 0.2386 | 0.1018 | ND | 0.7801 | 0.1876 | 0.2979 |
| 1271 | 0.0578 | 0.1292 | 0.051 | 0.1292 | 0.0464 | 0.0994 | ND | 0.916 | 0.1568 | 0.3915 |
| 1272 | 0.0673 | 0.0555 | 0.06 | 0.0555 | 0.051 | 0.1013 | ND | 0.6001 | 0.1717 | 0.2370 |
| 1273 | 0.0645 | 0.0667 | 0.063 | 0.0667 | 0.0972 | 0.1059 | ND | 0.3102 | 0.152 | 0.1479 |
| 1274 | 0.0583 | 0.0493 | 0.057 | 0.0493 | 0.0716 | 0.1201 | ND | 0.4213 | 0.1671 | 0.1733 |
| 1275 | 1.4152 | 1.3084 | | 1.3084 | 0.0853 | 0.0692 | ND | | | |
| 1276 | | | | | 0.2304 | 0.1167 | ND | | | |
| 1277 | 0.0467 | 0.0755 | 0.05 | 0.0755 | 0.0683 | 0.0682 | ND | 0.9456 | 0.1632 | 0.3655 |
| 1278 | 0.0511 | 0.0563 | 0.052 | 0.0563 | 0.0586 | 0.0705 | ND | 0.6354 | 0.1483 | 0.2493 |
| Minimal epitope on ferritin (10) | | | | | | | | | | |
| 1279 | 0.4585 | 0.3412 | 0.516 | 0.3412 | 0.0572 | 0.0542 | ND | | 1.4897 | 0.8960 |
| 1280 | 0.0868 | 0.0545 | 0.074 | 0.0545 | 0.0569 | 0.0485 | ND | 0.5017 | 0.1722 | 0.2036 |
| Domain III on LS (2) | | | | | | | | | | |
| 1281 | | | | | 1.0938 | 0.2008 | ND | | | |
| 1282 | | | | | 0.1031 | 0.0552 | ND | | | |
| Domain III on hcp1 (4) | | | | | | | | | | |
| 1283 | | 1.3892 | | 1.2219 | 0.3614 | 0.1108 | ND | | | |
| 1284 | | 1.3049 | 1.746 | 0.5965 | 0.124 | 0.0564 | ND | | | |
| 1285 | | 0.5993 | | 0.7303 | 0.212 | 0.0755 | ND | | | 1.3504 |
| 1286 | | 0.6031 | | 0.9592 | 0.0736 | 0.0595 | ND | | | 1.4363 |

FIG. 75
DS immunization can prevent RSV infection in mice

FIG. 78 DS-CAV1 can be effectively formulated in alum and retain immunogenicity

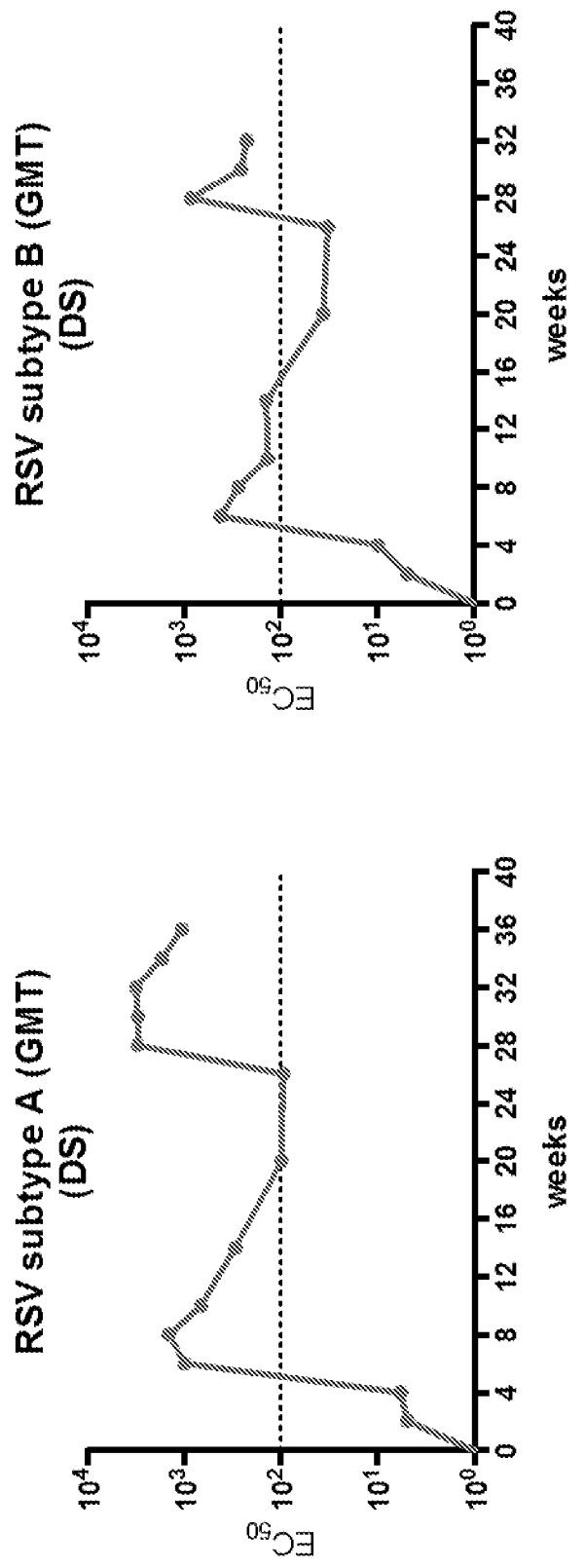
FIG. 79 Alum is an effective adjuvant in NHP

FIG. 80

DS-CAV1 is immunogenic when expressed from a gene-based vector either alone or as priming for a protein boost

FIG. 81

DS-Cav1 RSV F Subtype A or B Boosts rAd-F(A)WT-Primed NHP

FIG. 82 DS-Cav1 RSV F Subtype A or B Boosts rAd-F(A)WT-Primed NHP

FIG. 83

Immunization with DS version of stabilized prefusion F subtype A or B or both induces neutralizing activity against both subtypes

FIG. 84

Altering glycosylation reduces immunogenicity of stabilized prefusion F

PREFUSION RSV F PROTEINS AND THEIR USE

RELATED APPLICATIONS

This is the U.S. National Stage of international Application No. PCT/US2014/026714, filed Mar. 13, 2014, which was published in English under PCT Article 21(2), which in turn, claims the benefit of U.S. Provisional Application No. 61/780,910, filed Mar. 13, 2013, No. 61/798,389, filed Mar. 15, 2013, No. 61/857,613, filed Jul. 23, 2013, and No. 61/863,909, filed Aug. 9, 2013. Each of the provisional applications are incorporated by reference herein in its entirety.

FIELD

This disclosure relates to polypeptides, polynucleotides, compositions, and methods of their use, for elicitation and detection of an immune response to respiratory syncytial virus (RSV).

BACKGROUND

Respiratory syncytial virus (RSV) is an enveloped non-segmented negative-strand RNA virus in the family Paramyxoviridae, genus *Pneumovirus*. It is the most common cause of bronchiolitis and pneumonia among children in their first year of life. RSV also causes repeated infections including severe lower respiratory tract disease, which may occur at any age, especially among the elderly or those with compromised cardiac, pulmonary, or immune systems. Passive immunization currently is used to prevent severe illness caused by RSV infection, especially in infants with prematurity, bronchopulmonary dysplasia, or congenital heart disease. Current treatment includes administration of a RSV-neutralizing antibody, Palivizumab (SYNAGIS®; MedImmune, Inc.), which binds a 24-amino acid, linear, conformational epitope on the RSV Fusion (F) protein.

In nature, the RSV F protein is initially expressed as a single polypeptide precursor, designated $F_0$. $F_0$ trimerizes in the endoplasmic reticulum and is processed by a cellular furin-like protease at two conserved sites, generating, $F_1$, $F_2$ and Pep27 polypeptides. The Pep27 polypeptide is excised and does not form part of the mature F protein. The $F_2$ polypeptide originates from the N-terminal portion of the $F_0$ precursor and links to the $F_1$ polypeptide via two disulfide bonds. The $F_1$ polypeptide originates from the C-terminal portion of the $F_0$ precursor and anchors the mature F protein in the membrane via a transmembrane domain, which is linked to an ~24 amino acid cytoplasmic tail. Three protomers of the $F_2$-$F_1$ heterodimer assemble to form a mature F protein, which adopts a metastable prefusion conformation that is triggered to undergo a conformational change that fuses the viral and target-cell membranes. Due to its obligatory role in RSV entry, the RSV F protein is the target of neutralizing antibodies and the subject of vaccine development; however, like other RSV antigens, prior efforts to develop an RSV F protein-based vaccine have proven unsuccessful.

SUMMARY

As described herein, the three-dimensional structure of RSV F protein in its pre-fusion conformation was elucidated. The disclosure reveals for the first time the atomic level details of the prefusion conformation of RSV F, which presents a unique antigenic site ("antigenic site Ø") at its membrane distal apex. Using the three-dimensional structure of prefusion F as a guide, stabilized forms of prefusion F ("PreF" antigens) were engineered and constructed, and used to generate RSV neutralizing immune responses many fold greater than that achieved with prior RSV F protein-based immunogens, and which provide protection against RSV challenge in animal models. The PreF antigens can be used, for example, as both potential vaccines for RSV and as diagnostic molecules.

Isolated recombinant RSV F proteins that are stabilized in a prefusion conformation, as well as nucleic acid molecules encoding the recombinant RSV F proteins are disclosed. In several embodiments, the recombinant RSV F proteins are stabilized in a prefusion conformation that can specifically bind to a prefusion-specific antibody, such as a D25, 5C4, AM22, and/or MPE8 antibody. In several embodiments, the recombinant RSV F protein comprises an antigenic site Ø comprising residues 62-69 and 196-209 of a RSV F protein sequence, such as SEQ ID NO: 370. In some embodiments, the immunogen can specifically bind to the antibody after the immunogen is incubated at 20° C. in phosphate buffered saline at physiological pH for at least 24 hours in the absence of the antibody. In further embodiments, the immunogen can form a homogeneous population when dissolved in aqueous solution, wherein at least 90% of the immunogen in the population can specifically bind to the prefusion-specific antibody.

In some embodiments, the $F_2$ and $F_1$ polypeptides comprise RSV F positions 62-69 and 196-209, respectively, and the $F_2$ polypeptide comprise or consists of 8-84 residues of RSV F positions 26-109, and the $F_1$ polypeptides comprise or consists of 14-393 residues of RSV F positions 137-529, wherein the RSV F positions correspond to the amino acid sequence of a reference $F_0$ polypeptide set forth as SEQ ID NO: 124.

In several embodiments, the recombinant RSV F protein includes one or more amino acid substitutions that stabilize the protein in the prefusion conformation, for example, that stabilize the membrane distal portion of the F protein (including the N-terminal region of the F1 polypeptide) in the prefusion conformation. For example, the amino acid substitution can introduce a non-natural disulfide bond or can be a cavity-filling amino acid substitution. In several embodiments, the recombinant RSV F protein includes S155C and S290C substitutions that form a non-natural disulfide bond that stabilizes the protein in a prefusion conformation; that is, in a conformation that specifically binds to one or more pre-fusion specification antibodies, and/or presents an antigenic site, such as antigenic site Ø, that is present on the pre- but not post-fusion conformation of RSV F protein. In further embodiments, the recombinant RSV F protein can further include a F, L, W, Y, H, or M substitution at position 190, position 207, or positions 190 and 207. In one non-limiting example, the recombinant RSV F protein includes S155C, S290C, S190F, and V207L substitutions (referred to herein as "DSCav1").

In additional embodiments, the recombinant RSV F protein can include one or more modifications to the C-terminus of the F1 polypeptide (such as truncations and amino acid substitutions) that, together with the modifications that stabilize the membrane distal region of the F polypeptide, can increase stabilization of the recombinant F protein in the prefusion conformation. Exemplary modifications include linkage of the $F_1$ polypeptide to a trimerization domain (such as a foldon domain) or introduction of one or more cysteine residues in the C-terminal region of the F1 polypeptide (for example, at positions 512 and 513) that can form interprotomer disulfide bonds.

The PreF antigen can be included on a protein nanoparticle, or on a viral-like particle. Nucleic acid molecules encoding the PreF antigens are also disclosed. In some embodiments, the PreF antigen includes a recombinant RSV F protein that is a single chain RSV F protein.

Additional embodiments include an epitope-scaffold protein including RSV F positions 62-69 and 196-209, or a circular permutant thereof, linked to a heterologous scaffold protein, wherein the epitope scaffold protein specifically binds to a prefusion-specific antibody.

Compositions including the PreF antigens, protein nanoparticle, nucleic acid molecule or vector are also provided. The composition may be a pharmaceutical composition suitable for administration to a subject, and may also be contained in a unit dosage form. The compositions can further include an adjuvant.

Methods of generating an immune response in a subject are disclosed, as are methods of treating, inhibiting or preventing a RSV infection in a subject. In some embodiments of the methods, a subject, such as a human or bovine subject, is administered an effective amount of a disclosed antigen and/or a nucleic acid molecule encoding a disclosed antigen. In some embodiments, the methods include administration of an immunogenic composition including an adjuvant selected to elicit a Th1 biased immune response in a subject. In additional embodiments, the methods include a prime boost immunization, using human subtype A and human subtype B RSV F proteins stabilized in a prefusion conformation with the modifications disclosed herein. Methods for detecting or isolating an RSV binding antibody in a subject infected with RSV are disclosed. In some embodiments, the recombinant RSV F proteins can be used to detect and quantify target antibodies in a polyclonal serum response.

The foregoing and other objects, features, and advantages of the embodiments will become more apparent from the following detailed description, which proceeds with reference to the accompanying figures.

BRIEF DESCRIPTION OF THE FIGURES

FIGS. 1A-1C are a set of graphs and an diagram illustrating RSV neutralization, F glycoprotein recognition, and the crystal structure of human antibody D25 in complex with the prefusion RSV F trimer. The prefusion conformation of RSV F is metastable, and when expressed in a soluble form readily adopts the postfusion state; a number of potent antibodies, including D25, bind to a newly revealed antigenic site at the top of the prefusion F glycoprotein. (A) RSV neutralization by antibodies including palivizumab, the FDA-approved prophylactic antibody to prevent severe RSV disease. (B) Enzyme linked immunosorbant assay (ELISA) measuring antibody binding to postfusion F glycoprotein. (C) D25-RSV F trimer structure in ribbon and molecular surface representations. One protomer of the F glycoprotein trimer is shown as ribbons. Molecular surfaces are shown for the other two F protomers. The D25 Fab bound to the F protomer shown in ribbons is also displayed in ribbon representation, with heavy chain shaded dark grey and light chain shaded light grey. The other D25 Fabs are shaded same, but shown in surface representation.

FIGS. 2A and 2B are a set of diagrams and a sequence aligned with RSV secondary structure illustrating the structural rearrangement of RSV F. To mediate virus-cell entry, the RSV F glycoprotein transitions from a metastable prefusion conformation to a stable postfusion conformation. (A) Prefusion and postfusion structures. Outer images display prefusion (left) and postfusion (right) trimeric structures, shaded the same as in FIG. 1C. A complex glycan, shown as sticks, is modeled at each of the three N-linked glycosylation sites found in the mature protein. Inner images display a single RSV F protomer in ribbon representation. (B) RSV F sequence and secondary structure. Sites of N-linked glycosylation are highlighted by black triangles, antigenic sites are labeled, and downward arrows indicate the position of furin cleavage sites. Secondary structures are shown below the sequence (SEQ ID NO: 370), with cylinders representing α-helices and arrows representing β-strands. Disordered or missing residues are indicated by an "X"; residues that move over 5 Å between prefusion and postfusion conformations shown with grey shadow and are boxed.

FIGS. 3A-3C show a set of diagrams and a sequence alignment illustrating the RSV F interface with D25. Antibody D25 binds a quaternary epitope spanning two protomers at the apex of the prefusion F trimer. (A) Close-up of the interface between D25 and RSV F. Side chains of F residues interacting with D25 are labeled and shown as sticks. Oxygen atoms are shaded light grey and nitrogen atoms are shaded dark grey. Hydrogen bonds are depicted as dotted lines. The two images are related by a 90° rotation about the vertical axis. (B) Position and conformation of the D25 epitope on the prefusion and postfusion F molecules. RSV F residues at the D25 interface are shown. Polarity of α4 and α5$_{post}$ indicated with arrows, with fragment N- and C-termini indicated. (C) Sequence conservation of F residues in regions recognized by D25. Residues 3-74 and 200-213 of SEQ ID NO: 1 (hRSV/A), SEQ ID NO: 129 (hRSV/R), and SEQ ID NO: 178, bRSV) are shown. Amino acids in human RSV subtype B (hRSV/B) or in bovine RSV (bRSV) that differ from hRSV/A are underlined. Ectodomain is defined as F residues 26-109 and 137-524.

FIG. 6 shows a set of ribbon diagrams illustrating the comparison of D25-bound RSV F to prefusion PIV5 F. Ribbon representation of D25-bound RSV F (+) Fd (left) and PIV5 F-GCNt (right). There is excellent agreement of secondary structure elements between the two proteins, despite having only ~12% sequence identity. One of the most striking differences is the location of the fusion peptide (N-terminus of $F_1$ subunit), also shown in FIG. 7. The PIV5 F structure was described as consisting of three domains: I, II and III (Yin et al., *Nature*, 439, 38 (2006)). Domain III termed the membrane distal lobe, whereas domains I and II encompass the central barrel and membrane proximal lobe. The cleaved PIV5 structure shown here was generated from PDB ID: 4GIP (Welch et al., *Proc. Natl. Acad. Sci.*, U.S.A. 109, 16672 (2012)).

FIG. 7 shows a series of diagrams illustrating Type I prefusion viral glycoproteins. Prefusion structures of RSV F, PIV5 F (PDB ID: 4GIP (Welch et al., *Proc. Natl. Acad. Sci.*, U.S.A. 109, 16672 (2012)), influenza HA (PDB ID: 2HMG; Wilson et al., *Nature*, 289, 366 (1981)) and Ebola GP (PDB ID: 3CSY; Lee et al., *Nature*, 454, 177 (2008)) are shown as molecular surfaces, with each protomer colored differently. On the bottom row, a sphere is shown for the C-terminal residue of $F_2$ (RSV and PIV5) or $HA_1$ (Flu), and a sphere is show for the N-terminal residue of the fusion peptide. The RSV and PIV5 are both paramyxoviruses and their F proteins share ~12% sequence identity. Although Ebola GP is a type I fusion protein, it lacks a free N-terminal fusion peptide on GP2, and instead contains an internal fusion loop that is commonly seen in type II and type III fusion proteins. Thus, the Ebola GP was omitted from the fusion peptide comparison.

FIG. 8 is a set of graphs concerning RSV neutralization by IgG and Fab. D25, AM22 and Motavizumab neutralize RSV equally well as IgG or Fab. Note that the x-axis for the Motavizumab plot is different than the others.

FIGS. 9A and 9B are a series of diagrams and graphs illustrating properties of antigenic sites on the RSV F glycoprotein. Only antibodies directed to antigenic site Ø bind specifically to the prefusion conformation and have exceptional neutralization potency. (A) For site Ø, an image of a single D25 Fab binding to the prefusion RSV F trimer is shown, along with neutralization curves for AM22 and D25. For site I, arrows point to Pro389, a known escape mutation (Lopez et al., *J. Virol.*, 72, 6922 (1998)). A neutralization curve is shown for antibody 131-2a. Like antibody 2F (Magro et al., *J. Virol.*, 84, 7970 (2010)), antibody 131-2a only neutralizes ~50% of the virus. (B) For antigenic sites II and IV, models of Motavizumab (site II) and 101F (site IV) binding to the prefusion and postfusion (McLellan et al., *J. Virol.*, 85, 7788 (2011)) F structures were made using the coordinates of antibody-peptide structures (McLellan et al., *J. Virol.*, 84, 12236 (2010); McLellan et al., *Nat. Struct. Mol. Biol.*, 17, 248 (2010)).

FIG. 11 is a set of graphs showing results from ELISA and gel filtration assays using the recombinant RSV F protein construct with S155C and S290C amino acid substitutions and a Foldon domain linked to the C-terminus of $F_1$. The ELISA data indicate that the S155C/S290C construct is specifically bound by RSV F prefusion specific antibodies. The gel filtration profiles show that the S155C/S290C construct exists solely as a trimer, whereas aggregates and rosettes form in solution with a control RSV F construct lacking the S155C/S290C substitutions.

FIG. 15 shows digital images of the crystals of a soluble recombinant RSV F protein stabilized in a prefusion conformation by S155C and S290C substitutions. Left, standard light images; Right, ultraviolet images, indicative of proteins. The formation of crystals from aqueous buffered solutions demonstrates that this protein is substantially homogeneous in solution.

FIG. 17 shows the antigenic characterization of RSV_A F(+)FdTHS DSCav1. The association and dissociation rates of soluble D25, AM22, 5C4, 101F, Motavizumab, and Palivizumab Fab interaction with immobilized RSV_A F(+) FdTHS DSCav1 were measured using an OctetRED 384™ instrument (ForteBio, Melno Park, Calif.). Equilibrium dissociation constants for each antibody are provided.

FIG. 21 shows comparison of RSV_A F(+)FdTHS DSCav1 to D25-bound RSV F. Ribbon representation of RSV_A F(+)FdTHS DSCav1, superposed with a ribbon representation of D25-bound RSV F colored white (PDB ID 4JHW). The images are related by a 90° rotation about the vertical axis.

FIG. 22 shows stabilizing mutations in RSV_A F(+) FdTHS DSCav1 structure. Ball-and-stick representation of RSV_A F(+)FdTHS DSCav1 crystal structure with $2F_o-F_c$ electron density contoured at $1\sigma$ is shown as a mesh. These images indicate that electron density corresponding to the disulfide bond between cysteine residues 155 and 290 (left), as well as the cavity-filling Phe190 residue (right), is observed.

FIGS. 26A-26D illustrate structure-based vaccine design for RSV: a supersite paradigm. (A) Natural infection by RSV elicits diverse antibodies, with a range of viral neutralization potencies. (B) A cluster of epitopes for naturally elicited, highly potent antibodies defines a supersite of viral vulnerability. Shown are antigen-binding fragments of the potently neutralizing antibody D25 recognizing an epitope at the apex of the RSV F trimer. Spatially overlapping epitopes at the trimer apex are also recognized by the AM22 and 5C4 antibodies, which share the same desired neutralization characteristics as D25. These overlapping epitopes define antigenic site Ø as a supersite of RSV vulnerability. (C) After selection of a target supersite, an iterative process of design, characterization of antigenic and physical properties, atomic-level structure determination, and assessment of immunogenicity allows for the structure-based optimization of vaccine antigens encoding the target supersite. (D) Because the supersite of viral vulnerability naturally elicits highly protective antibodies, immunization with "supersite immunogens" more easily elicits protective response than immunogens based on viral regions recognized by subdominant or non-potently neutralizing antibodies.

FIGS. 29A-29B show results concerning immunogenicity of engineered RSV F trimers. RSV F proteins engineered to stably display antigenic site Ø elicit neutralizing titers significantly higher than those elicited by postfusion F. (A) Neutralization titers of sera from mice immunized with 10 μg of RSV F (left). Postfusion F, as well as RSV F bound by antibodies AM22 or D25, were immunized at 20 μg per mouse (right). Geometric mean is indicated by a horizontal line. (B) Neutralization titers of sera from rhesus macaques immunized with 50 µg of RSV F protein variants. Geometric mean is indicated by a horizontal line. Protective threshold is indicated by a dotted line, and p-value provided for postfusion versus DS-Cav1.

FIGS. 30A-30D show how physical, structural, and antigenic properties of antigenic site Ø-stabilized RSV F correlate with immunogenicity. (A) Physical stability of site Ø versus immunogenicity. Inset shows information transFer Physical stability as determined by 7 measurements of D25 retention of activity in FIG. 31 were averaged (horizontal axis) and compared to elicited RSV-protective titers from FIG. 29 (vertical axis). (B) Structural mimicry of site Ø versus immunogenicity. Inset shows information transfer. Structural mimicry (horizontal axis) is the rmsd between different structures (FIG. 28) and D25-bound RSV F for all atoms within 10 Å of D25. This is compare to elicited RSV-protective titers from FIG. 29 (vertical axis). (C) Antigenic analysis of sera from immunized macaques. Binding of sera to immobilized DS-Cav1 (left) or postfusion F (right) was measured directly (Blank, black bars) or after incubation with excess postfusion F (dark grey bars) or DS-Cav1 (light grey bars). The mean response of the four macaque sera is graphed, with error bars for the standard deviation. (D) Correlation of immunogenicity and antigenicity of NHP sera. The mean neutralization titers of the four macaque sera in each group are plotted against the ratio of binding responses to DS-Cav1 and postfusion F.

FIGS. 31A-31B are a table showing the results of antigenic and physical characterization of RSV F protein immunogens. #Defined for trimeric state, but if no trimeric state could be purified, then the oligomeric state of the dominant oligomeric species. If total yield is <0.1 mg/l, then oligomeric state is not determined (N.D.). *Yield is shown for specific oligomeric state. >1000 nM=no binding at 1 µM Fab concentration. N/A=not applicable.

FIG. 32 shows the location of S155 and S290 in the pre- and postfusion RSV F structures. The β-carbons of serine residues 155 and 290 are 4.4 Å apart in the D25-bound RSV F structure and 124.2 Å apart in the postfusion structure. The mutations S155C and S290C (called "DS") restrained the structure in the prefusion conformation.

FIGS. 33A-33C shows negative staining of stabilized F-protein. A) and B) show representative fields of negatively stained specimens for DS and DS-Cav1. The proteins are highly homogenous with <1% and <0.1% of post-F conformations observed in DS and DSCav1, respectively. Examples of post-F conformations are indicated by black arrows. Bar=50 nm. 2D particle averages are shown as insets in the top right corner at twice the magnification. Bar=5 nm. C) shows a comparison of the 2D averages with the average of F+D25 complex (McLellan et al. 2013). Bar=5 nm.

FIGS. 38A-38B shows results concerning antigenic characterization of immunogen-adjuvant complexes for non-human primate immunization. (A) RSV F post fusion, DS and DS-Cav1 sample reactivity was assessed against 1 µM D25 antigen-binding fragment less than 3 h following immunogen formulation with Poly I:C and NHP immunizations at day 0 and (B) week 4.

FIGS. 39A-39B shows antigenic analysis of sera from immunized mice and rhesus macaques. A) Sera from mice immunized with multiple stabilized RSV F variants was assessed for binding to immobilized DS-Cav1 was measured directly or DS-Cav1 after incubation with excess D25 or motavizumab antigen-binding fragments to assess the site Ø or site II responses. B) Sera from rhesus macaques was assessed for binding to immobilized DS-Cav1 or postfusion RSV F variants also blocked with D25 or motavizumab antigen-binding fragments. The mean response of the animal sera is shown, with error bars for the standard deviation.

FIG. 40 shows crystallographic data collection and refinement statistics.

BALB/c mice were immunized with 20 µg of the DS S155C/S290C version of stabilized prefusion F derived from subtype A and formulated with alum (aluminum hydroxide gel 10 mg/ml, Brenntag, Frederikssund, Denmark) or polyI:C. Mice were inoculated at 0 and 3 weeks, and at the 5 week time point (2 weeks after the second injection), serum was obtained for neutralization assays.

Figure 43:
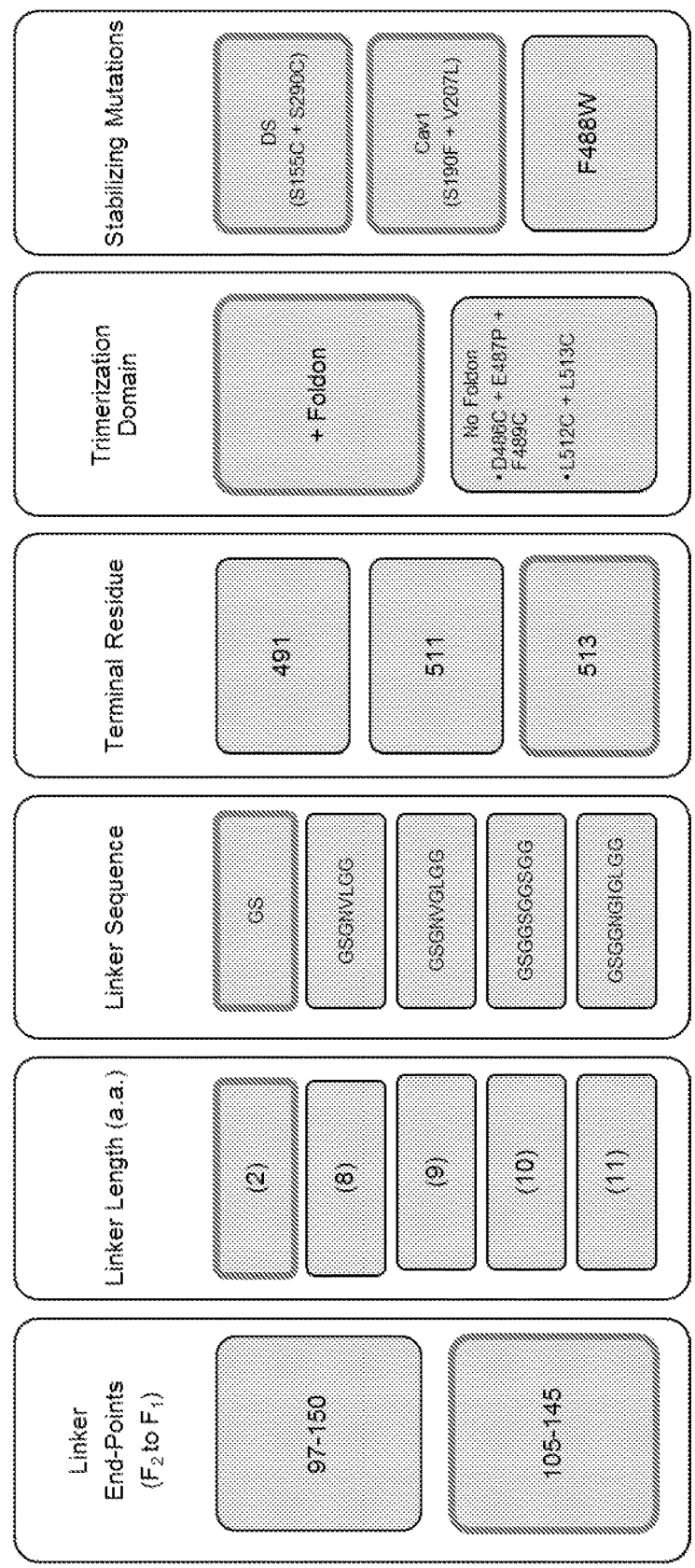

FIG. 43 is a schematic diagram illustrating an exemplary design scheme for prefusion-stabilized single-chain RSV F (scF) antigens, including the variables that are involved with several different RSV scF designs. Design elements that pertain to RSV scF no. 9 (BZGJ9 DS-Cav1; SEQ ID NO: 669 are outlined in dark grey.

Figure 44A:
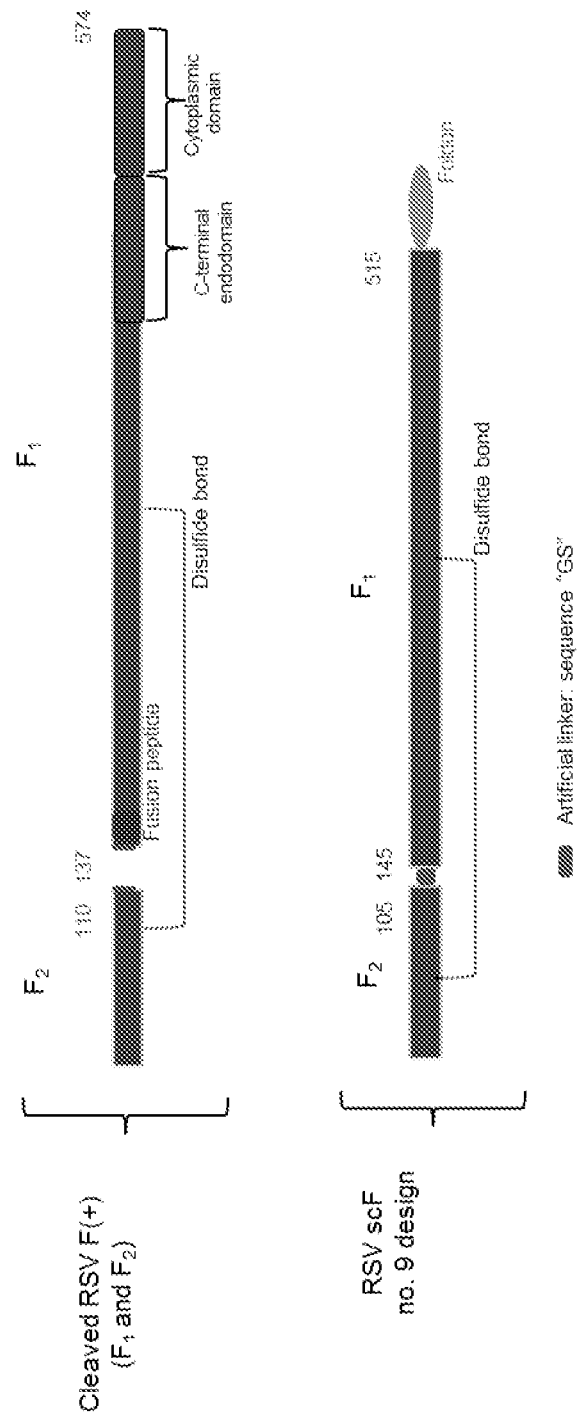
Figure 44B:
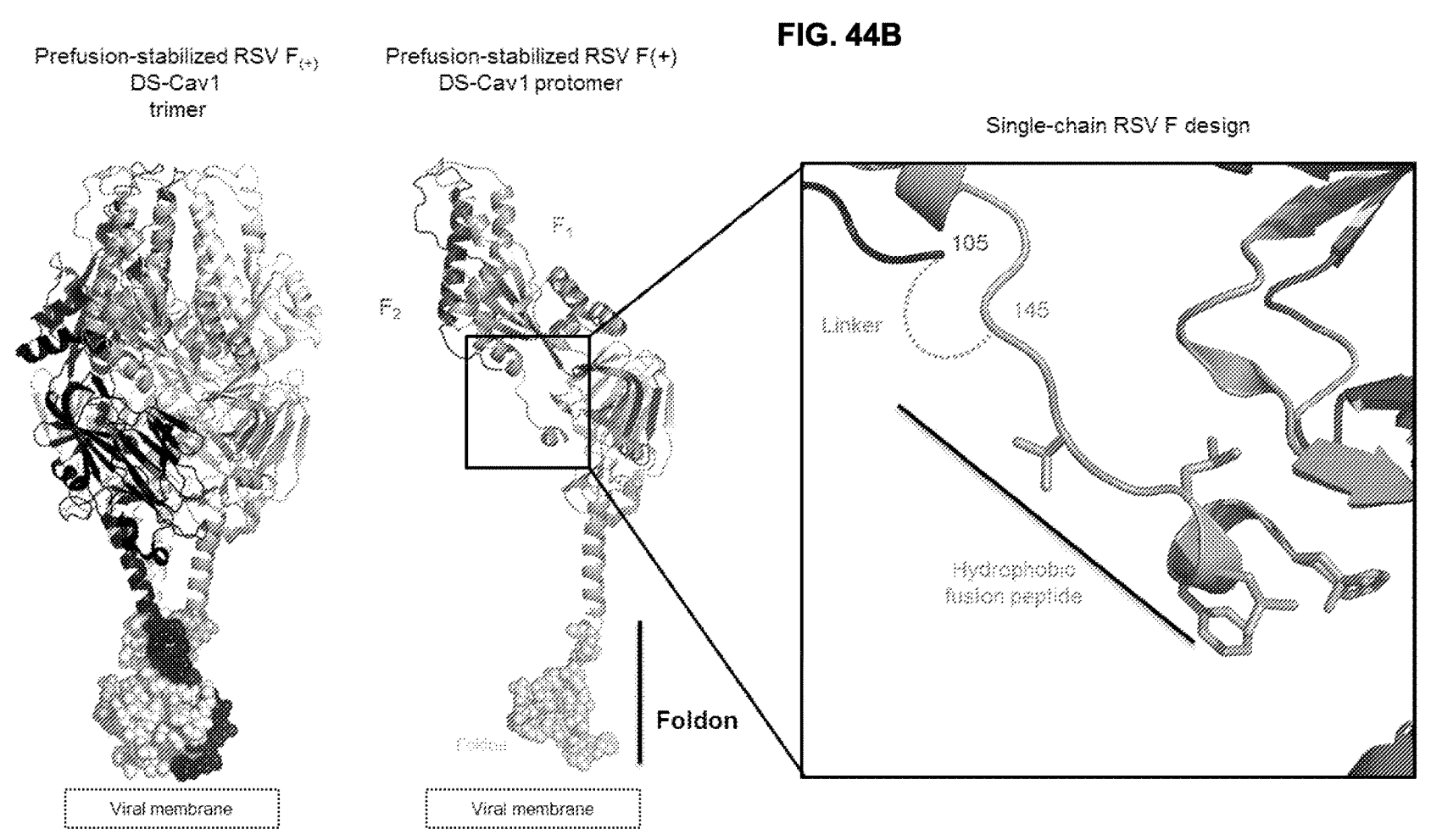

FIGS. 44A and 44B illustrate the design of single-chain RSV F construct no. 9 (scF no. 9; BZGJ9 DSCav1; SEQ ID NO: 669). Numbering indicates residue locations of the various components described below. (A) Schematic representations of furin-cleaved RSV F(+) glycoprotein as shown in FIG. 44B (top), and RSV scF no. 9 design (bottom), showing the foldon trimerization domain (grey oval), and the artificial linker (grey square) bridging the polypeptide backbones of F2 (left) and $F_1$ (right). (B) Structural basis for RSV scF no. 9 design using a prefusion-stabilized RSV F(+) structure as a model (PBD ID: 4MMV, incorporated by reference herein in its entirety). RSV F(+) is shown in cartoon representation and the foldon trimerization domain shown in sphere representation. Shown on the left is the prefusion-stabilized RSV F(+) trimer, with the three protomers colored black, gray, and white. Shown on the right is a single RSV F(+) protomer showing $F_1$ (medium gray), F2 (dark grey), the fusion peptide (indicated), and the foldon trimerization domain (light grey, indicated). The inset shows the fusion peptide in stick representation, and the location of the flexible linker sequence (dashed line) joining residues 104 and 147.

FIG. 45 shows a table concerning the design, oligomeric state, and production yield of engineered single-chain RSV F constructs expressed in HEK293-F cells. RSV F construct no. 9 DSCav1 (scF no. 9; BZGJ9 DSCav1; SEQ ID NO: 669), RSV F construct no. 10 DSCav1 (scF no. 10; BZGJ10 DSCav1; SEQ ID NO: 670) RSV F construct no. 11 DSCav1 (scF no. 11; BZGJ11 DSCav1; SEQ ID NO: 671) are indicated. The provided linker sequences include GSGNIGLGG (SEQ ID NO: 364), GSGGNGIGLGG (SEQ ID NO: 359), GSGNVLGG (SEQ ID NO: 361), and GSGNVGLGG (SEQ ID NO: 362). (%) Prefusion stabilizing mutations include the following: S155C and S290C (DS); S190F and V207L (Cav1); no additional mutations (a). All variants contain the point mutation L373R. (═) Trimerization domains include the following: L512C and L513C (CC); D486C, E487P, and F489C (CPC). (#) Variants were often observed to exist in a mixture of oligomer states on size chromatography. If a measurable trimeric fraction was observed, then oligomeric state is listed as "Trimer". If no trimeric fraction was observed, then the oligomeric state of the dominant species is provided. If the total yield prior to size chromatography was <0.1 mg/L, then oligomeric state is listed as not determined (N.D.). If oligomeric state was indistinguishable by size exclusion chromatography, oligomeric state is listed as "Aggregate". (*) Yield shown was calculated post-StrepTag purification and is listed for the specified oligomeric state. (Φ) HEK 293F yield is estimated based on observed ratio between Expi293F expression yield and Freestyle293F expression yield seen in scF constructs (~2:1).

Figure 46B:
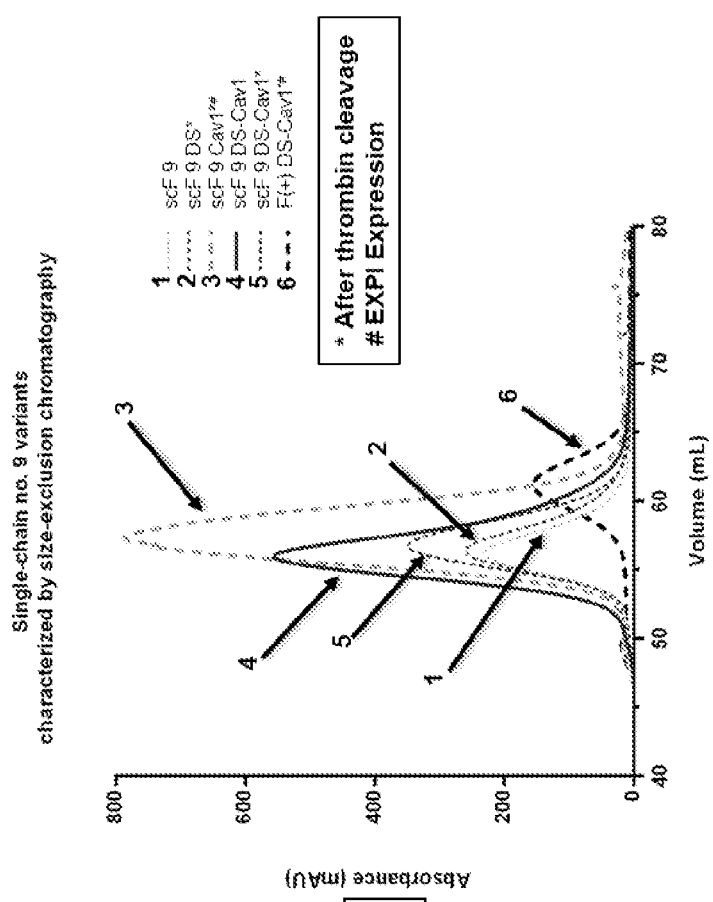
Figure 46A:
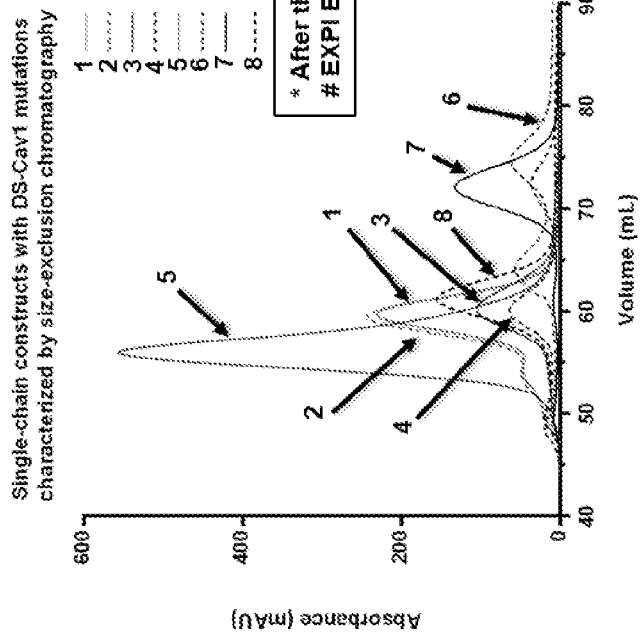

FIGS. 46A and 46B are a set of graphs illustrating characterization of the engineered single-chain RSV F glycoproteins by size-exclusion chromatography. (A) Size-exclusion profiles of RSV scF variants (scF no. 3, 4, 6, 8 though 11) and RSV $F_{(+)}$ containing DS-Cav1 stabilizing mutations. Single-chain constructs were expressed in HEK293F cells and F(+) DS-Cav1 was expressed in Expi 293-F cells. F(+) DS-Cav1 and scF no. 3 DS-Cav1, no. 4 DS-Cav1, no. 6 DS-Cav1, and no. 9 DS-Cav1 exhibit elution profiles characteristic of a globular trimeric protein, whereas scF no. 11 DSCav1 exhibits an elution profile characteristic of a globular monomeric protein. RSV scF no. 8 DS-Cav1 and scF no. 10 DS-Cav1 exhibit elution profiles suggesting a heterogeneous mixture of both monomeric and trimeric species. (B) Size-exclusion profiles of RSV F(+) DS-Cav1 and RSV scF no. 9 containing different stabilizing mutations. F(+) DS-Cav1, and scF no. 9 Cav1 were expressed in Expi 293-F cells and the remaining scF no. 9 variants were expressed in HEK293F cells. The slight deviation in the elution profiles of scF no 9 variants suggest that scF no. 9 runs at a higher molecular weight than trimeric F(+). An asterisk indicates that purification tags were cleaved prior to gel filtration.

FIG. 47 is a table summarizing the results of antigenic characterization of RSV scF no. 9 DS-Cav1.

FIG. 48 is a table showing the crystallographic data and refinement statistics for the three dimensional structure of RSV scF no. 9 DS-Cav1.

Figure 49A:
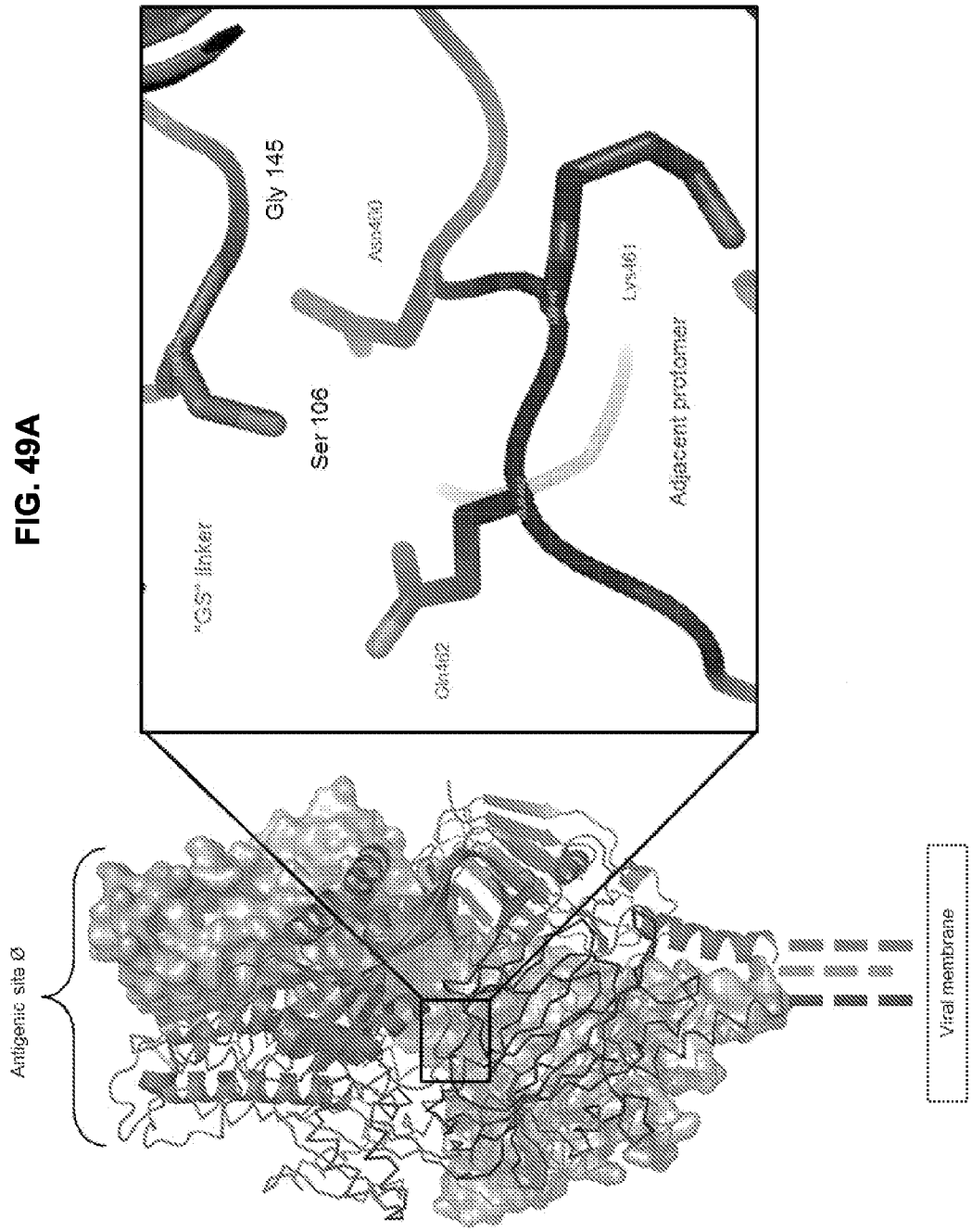
Figure 49B:
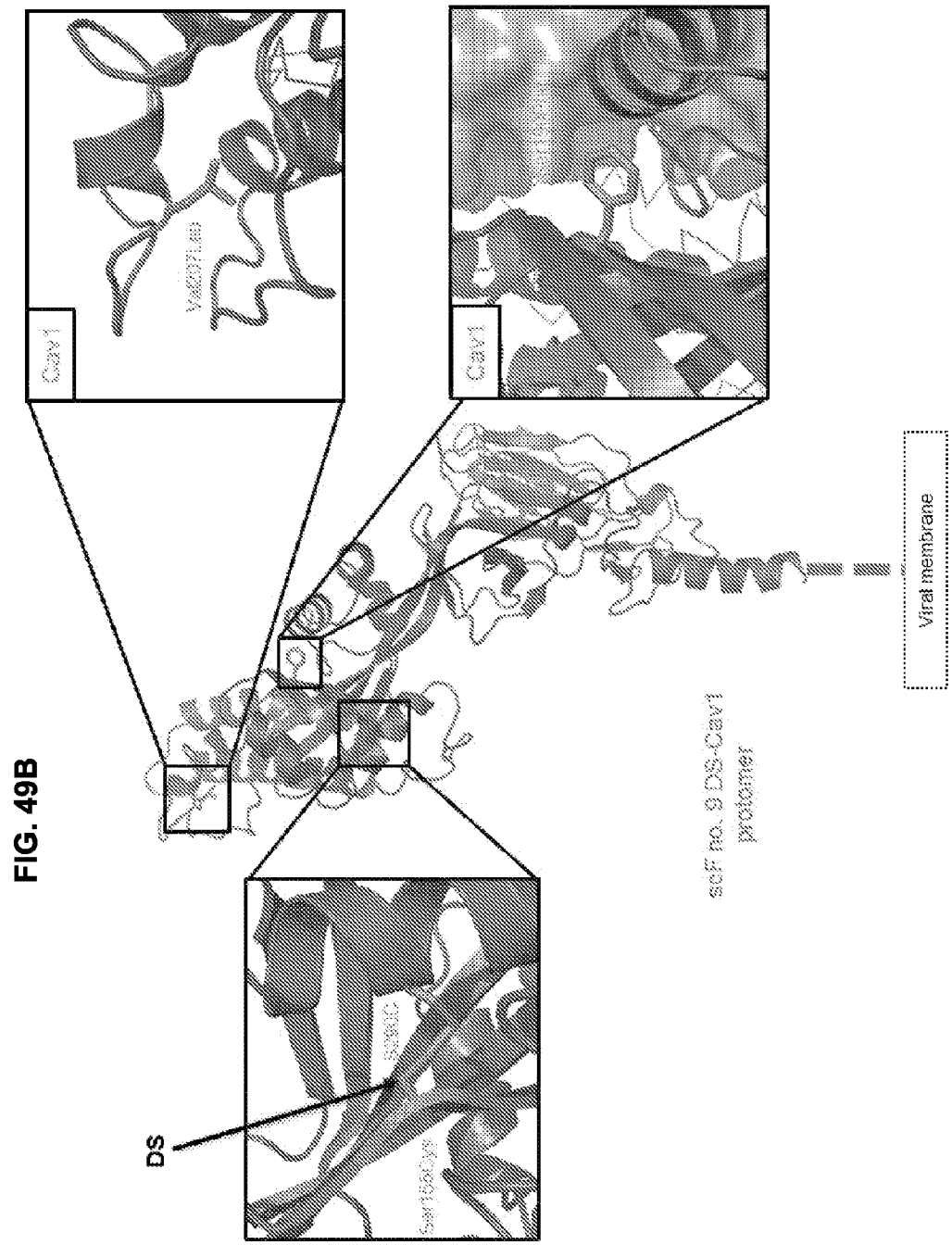

FIGS. 49A and 49B show a series of diagrams concerning the crystal structure of RSV scF no. 9 DS-Cav1 trimer. The orientation of the protomer displayed in cartoon representation (dark grey) is kept constant. Thick dotted lines represent the C-terminal foldon motif located at the membrane-proximal region, which is not visible in the crystal structure. (A) RSV scF no. 9 DS-Cav1 trimer displayed with protomers in cartoon representation and ribbon representation (dark grey), and molecular surface representation (light grey). Inset shows enlargement of the "GS" scF no. 9 linker loop (indicated) and the adjacent protomer (dark grey), both in stick representation. (B) Prefusion stabilizing mutations in the RSV scF no. 9 DS-Cav1 structure. DS and Cav1 prefusion stabilizing mutations are indicated and shown in stick representation.

Figure 50:
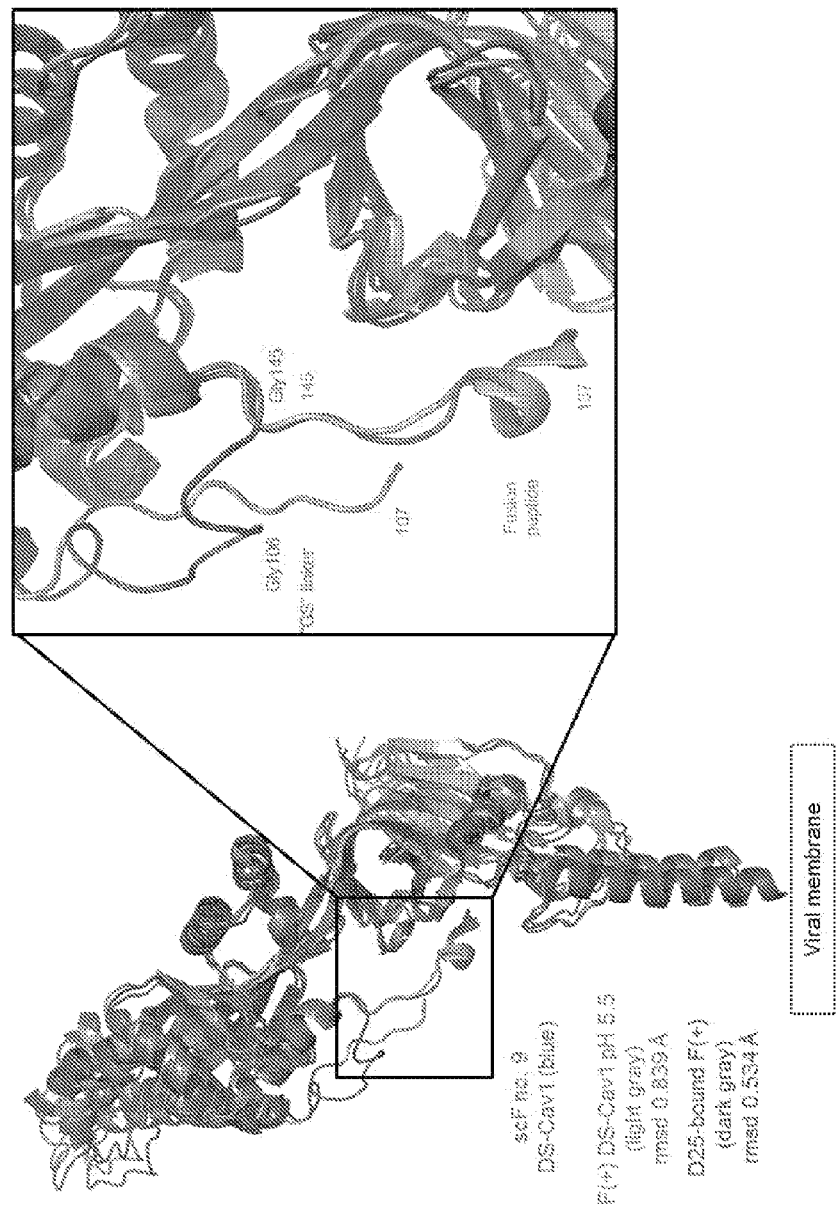

FIG. 50 is a diagram illustrating the structural alignment of RSV scF no. 9 DS-Cav1 (medium grey) with the F(+) DS-Cav1 structure (light gray; rmsd=0.839 Å) and with the D25-bound F(+) structure (dark gray; rmsd=0.534 Å), all displayed in cartoon representation. Inset shows a close-up of the scF no. 9 linker loop and the fusion peptides of the F(+) DS-Cav1 structure, and the D25-bound F(+) structure.

Figure 51:
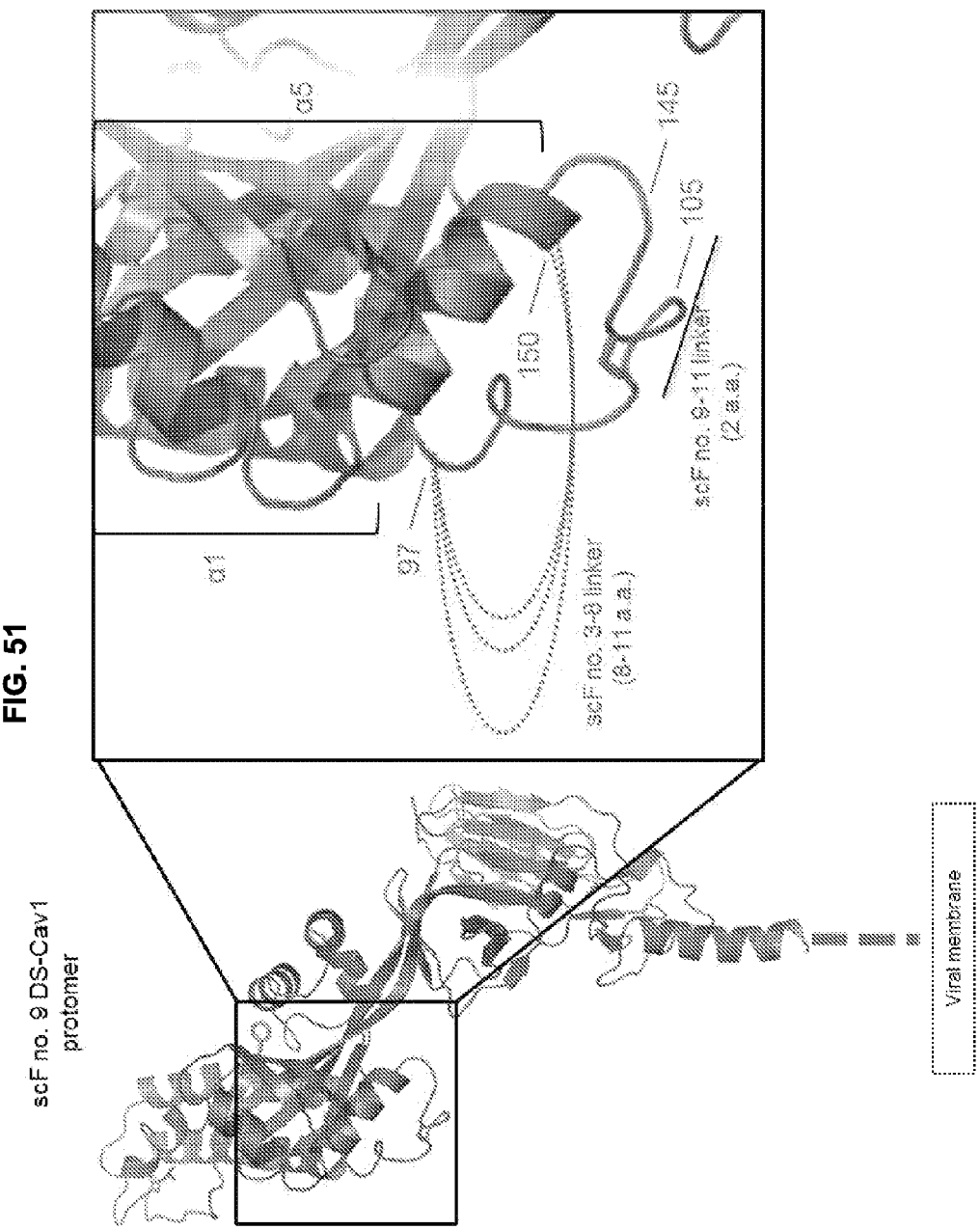

FIG. 51 shows diagrams illustrating the comparison of RSV scF designs no. 3, 4, 6, 8-11 using the crystal structure of RSV scF no. 9 DS-Cav1. Thick dotted lines represent the C-terminal foldon motif. RSV scF no. 9 DS-Cav1 protomer displayed in cartoon representation (dark grey). Inset shows enlargement of the "GS" scF no. 9 linker loop in stick representation joining residues 105 ($F_2$) and 145 ($F_1$). The predicted locations of the flexible linker sequences for scF designs no. 3, 4, 6 and 8 (thin dotted line) joining residues 97 ($F_2$) and 150 ($F_1$) are mapped onto the scF no. 9 DS-Cav1 crystal structure. The predicted locations of the linker sequences for scF designs no. 3, 4, 6 and 8 (thin dotted lines) are mapped onto the scF no. 9 DS-Cav1 trimer structure. Linker end point residue locations are approximated.

Figure 52:
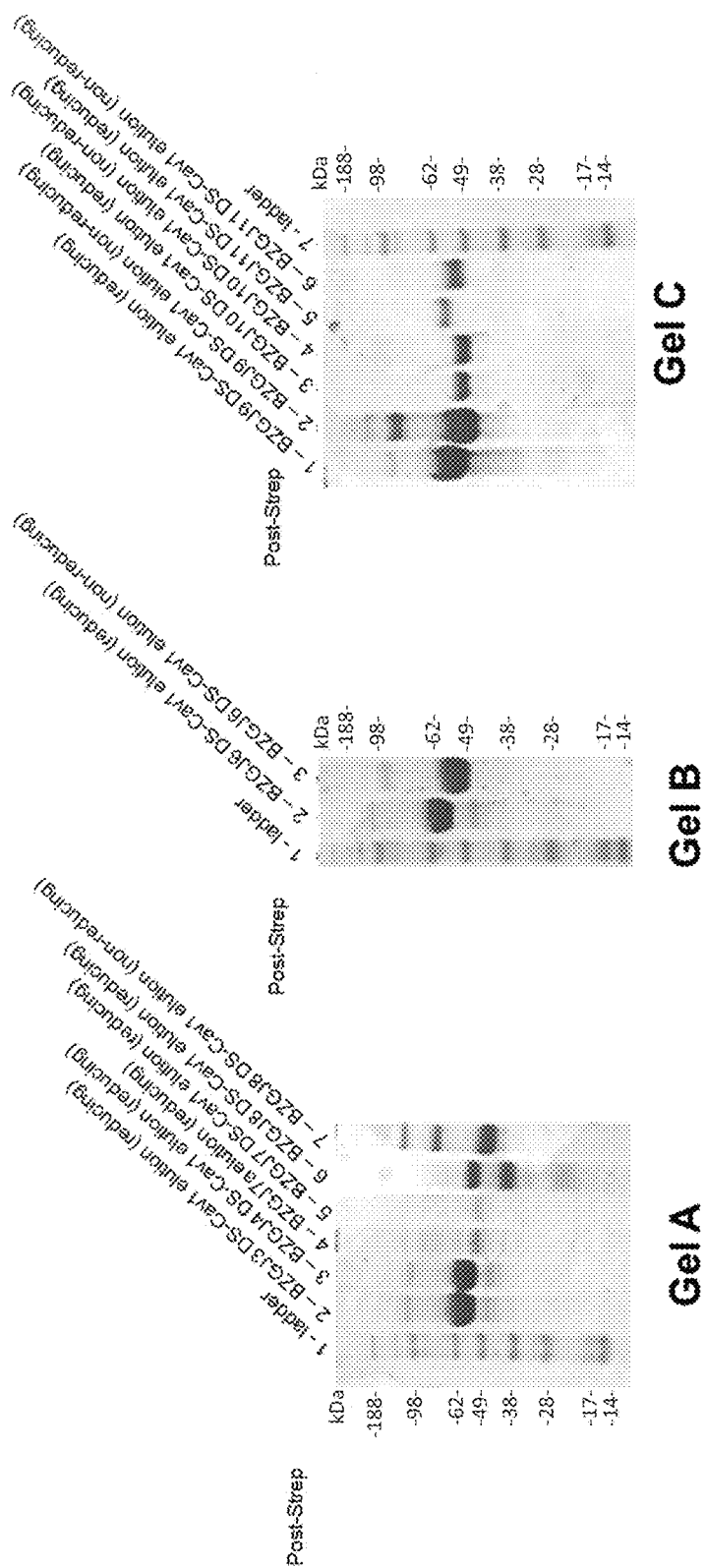

FIG. 52 shows a set of digital images concerning characterization of the engineered single-chain RSV F glycoproteins characterized by SDS-PAGE gel electrophoresis post StrepTag purification. RSV scF constructs were expressed in HEK293F cells and purified by His$_6$-tag and StrepTag affinity chromatography.

Figure 53:
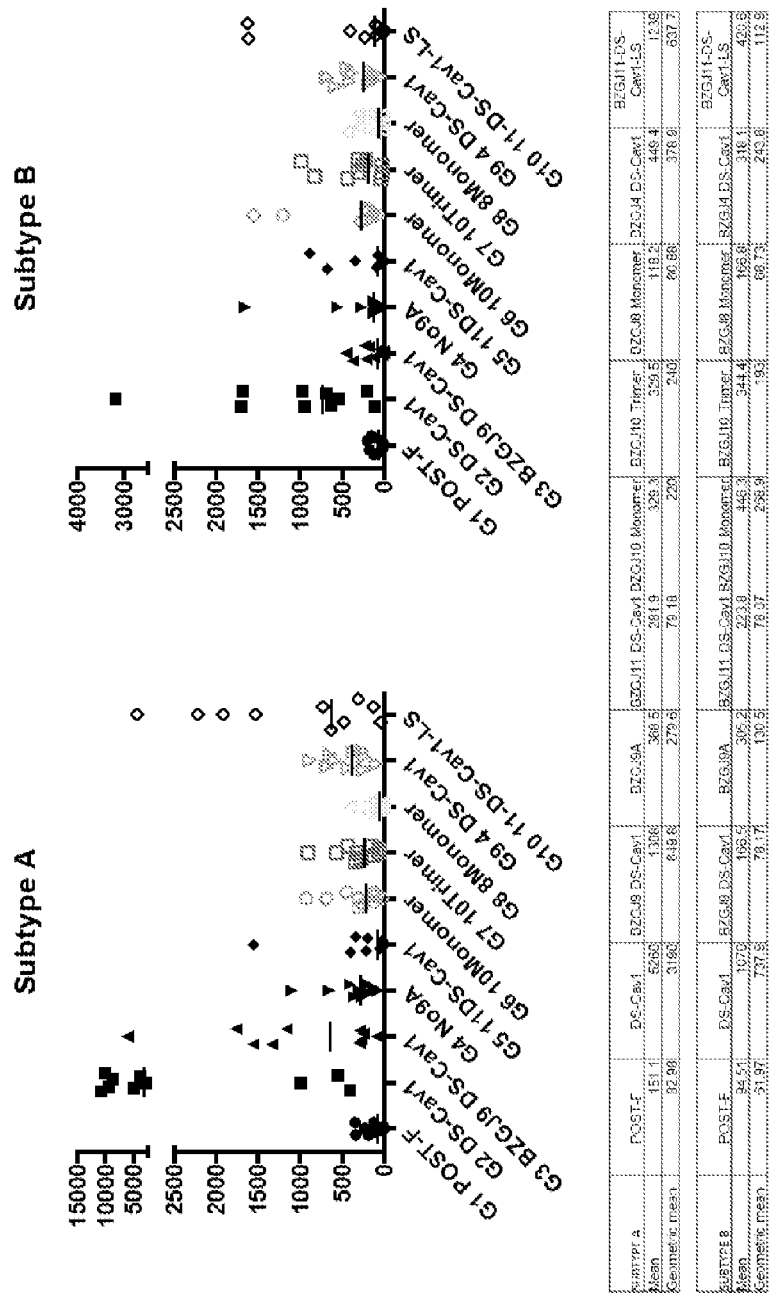

FIG. 53 is a set of graphs and a table providing week 5 neutralization data for the indicated constructs (10 animals/group). Immunizations at Week 0 and Week 3 with 10 µg protein+50 µg Poly I:C per animal.

Figure 54:
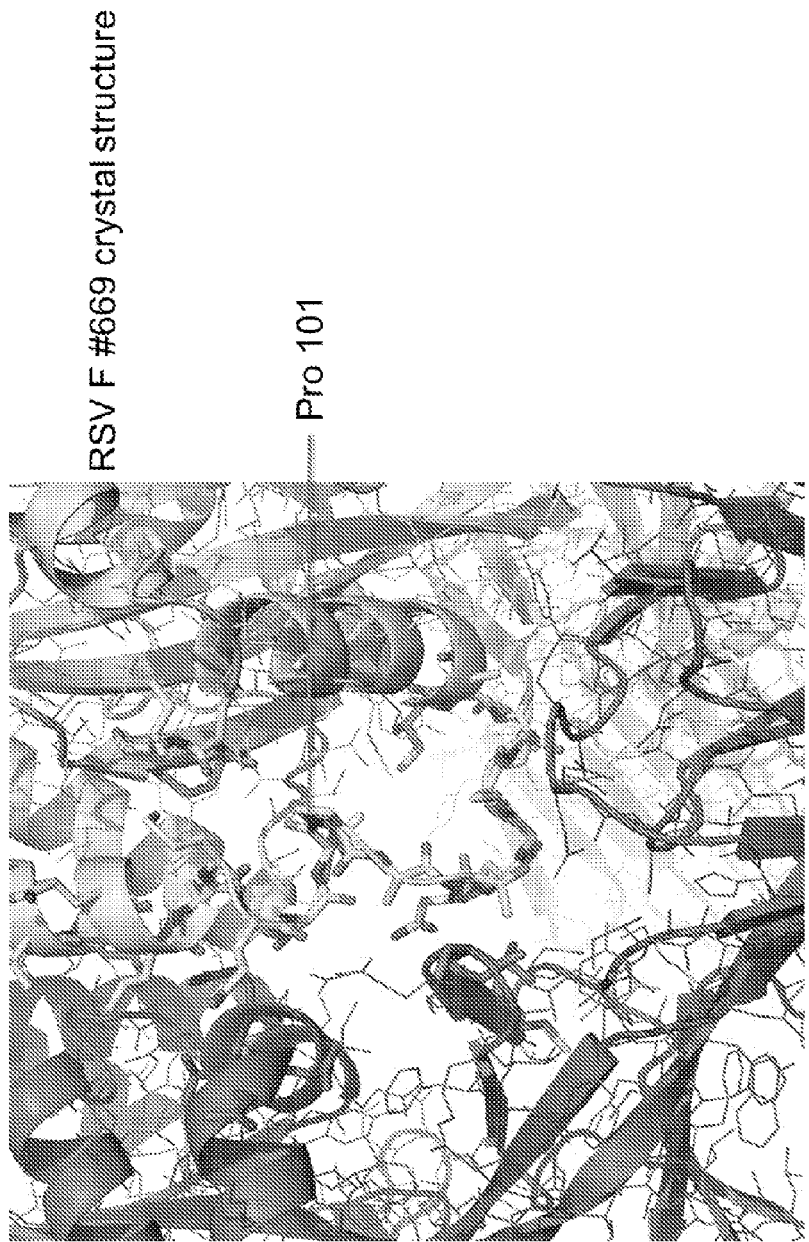

FIG. 54 is a ribbon and stick diagram highlighting the Proline residue at RSV F position 101 in the three-dimensional structure of RSV scF no. 9 (SEQ ID NO: 669). The structure indicates that the single chain linker region may be improved by removing Proline 101 or shortening/mutating the linker residues and adjacent residues.

Figure 55:
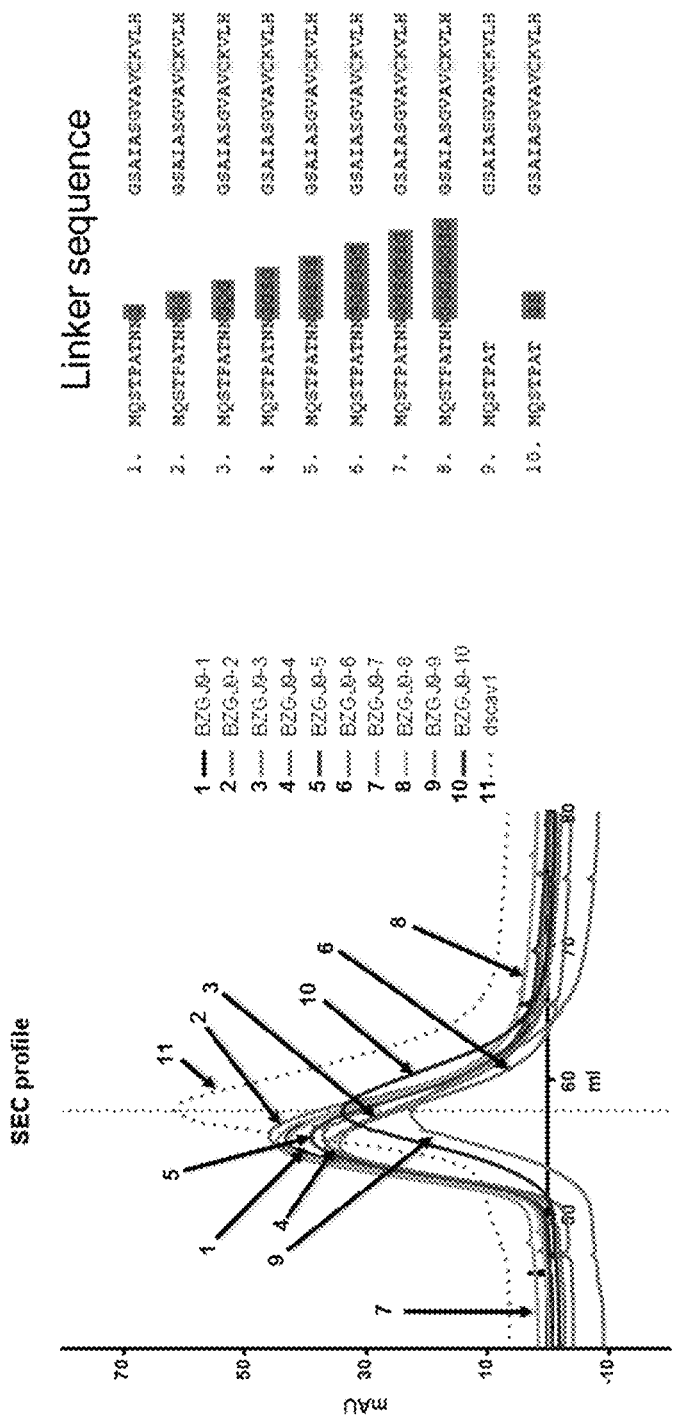

FIG. 55 is a graph and a sequence alignment illustrating modification of the scF no. 9 construct (SEQ ID NO: 669) to generate the BZG J9-1 to BZG J9-10 constructs. The sequence alignment shows BZG J9-1 to BZG J9-10 sequences corresponding to RSV F residues 97-159 of SEQ ID NOs: 698-707, respectively. These constructs were expressed in Expi cells and assessed by gel filtration (left).

Figure 56:
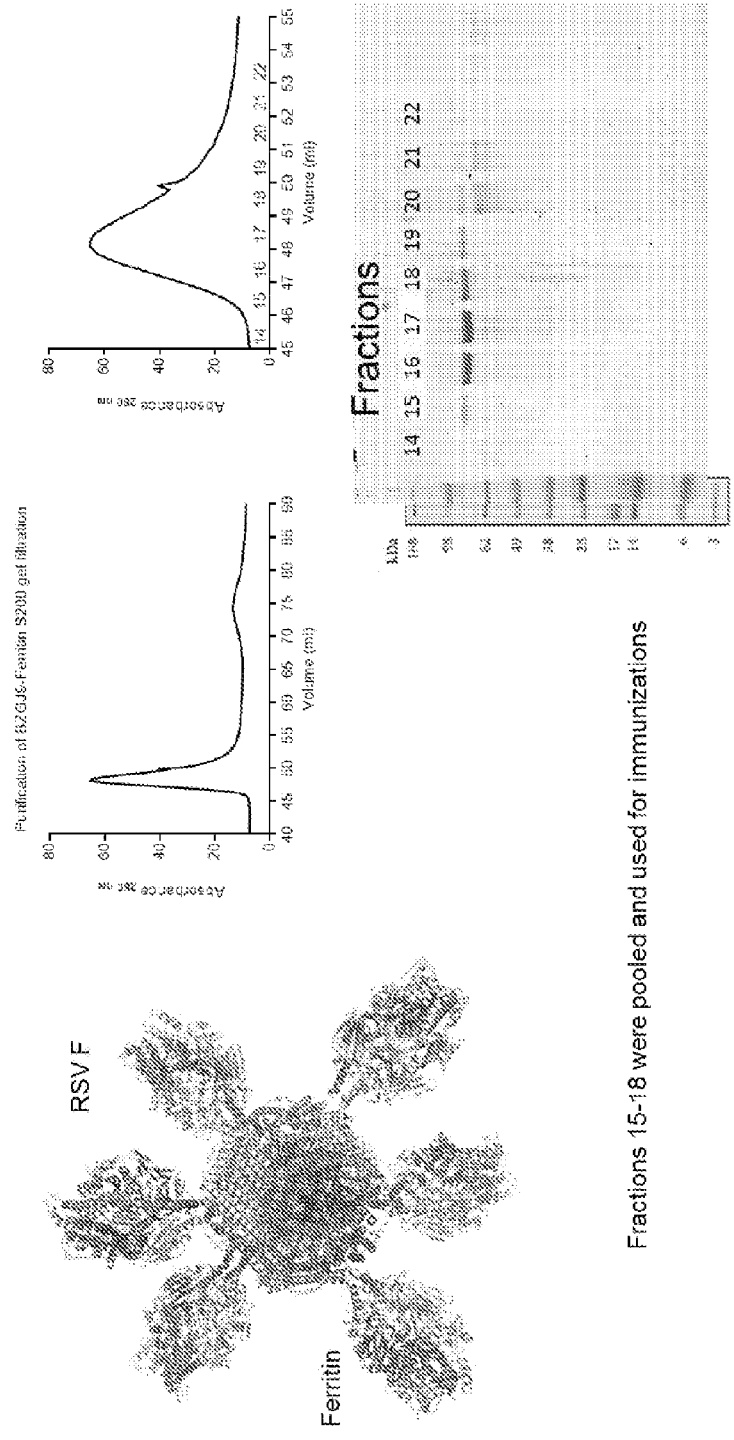

FIG. 56 is a series of graphs and schematic diagrams illustrating a ferritin nanoparticle including the scF no. 9 protein, which was generated by linking the C-terminus of the F1 polypeptide in scF no. 9 to a ferritin subunit. This construct is termed "BZGJ9-DS-Cav1-LongLink-Ferritin" and provided as SEQ ID NO: 1429.

FIG. 57 is a set of graphs illustrating the physical stability of BZGJ9-DS-Cav1-LongLink-Ferritin compared to RSV F DS-Cav1.

FIGS. 58A-58C are a set of graphs and a table illustrating the immunogenicity of different prefusion stabilized RSV F proteins. The three constructs tested were RSV F DSCav1 (SEQ ID NO: 371), BZGJ9-DS-Cav1-LongLink-Ferritin (SEQ ID NO: 1429), and scF no. 9 (also termed BZGJ9 DS-Cav1, SEQ ID NO: 669). *Macaca mulatta* animals of Indian origin weighing 8.26-11.34 kg were intramuscularly injected with immunogens at week 0 with 50 µg protein+500 µg Ribi per animal, Boost at Week 4 with 50 µg protein+500 µg Ribi per animal; immunogenicity was assessed at week 3.5.

Figure 59B:
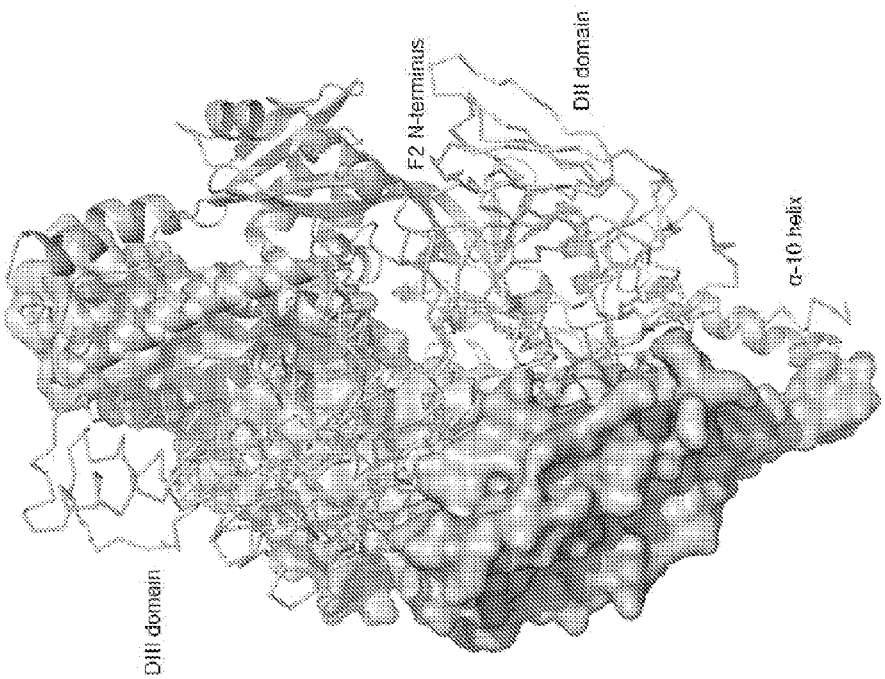
Figure 59A:
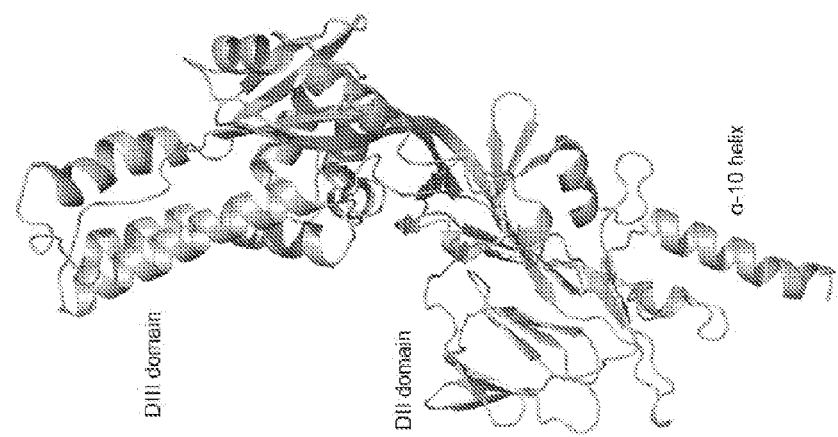
Figure 60A:
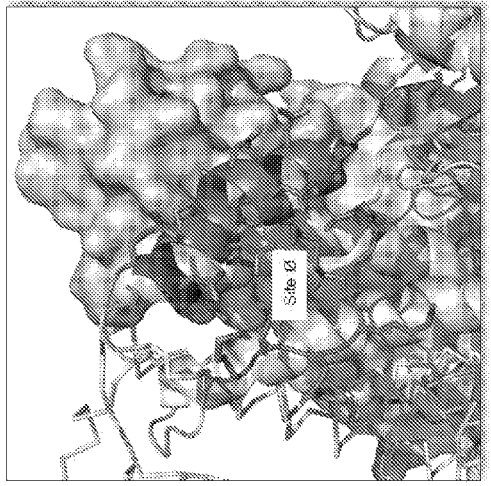
Figure 60B:
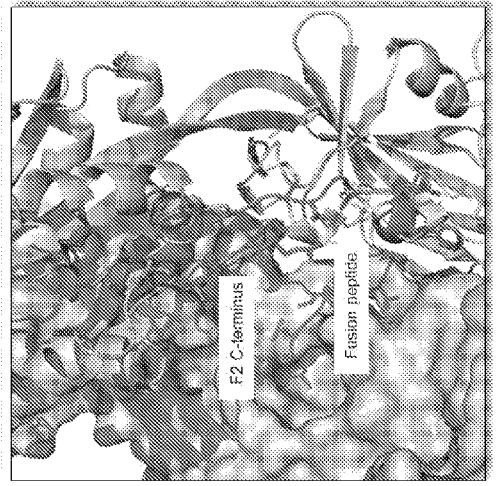
Figure 60C:
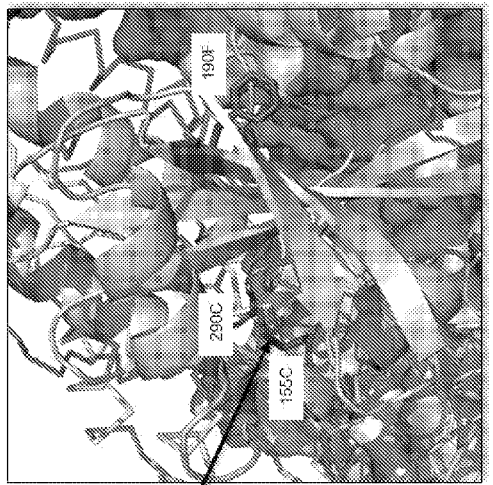
Figure 60D:
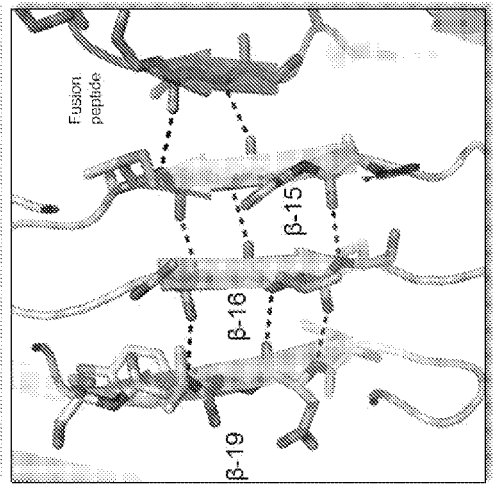
Figure 63:
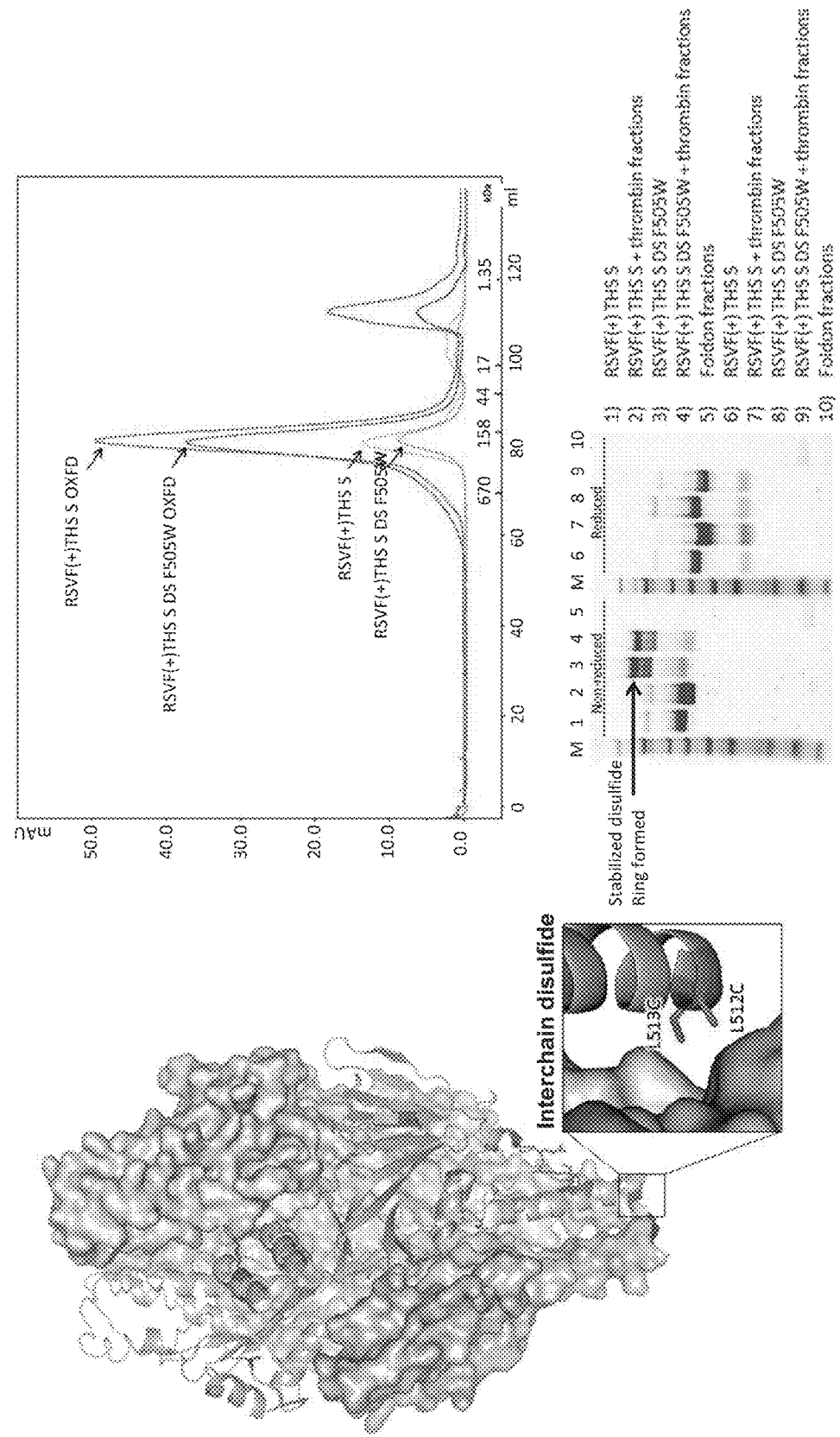
Figure 64:
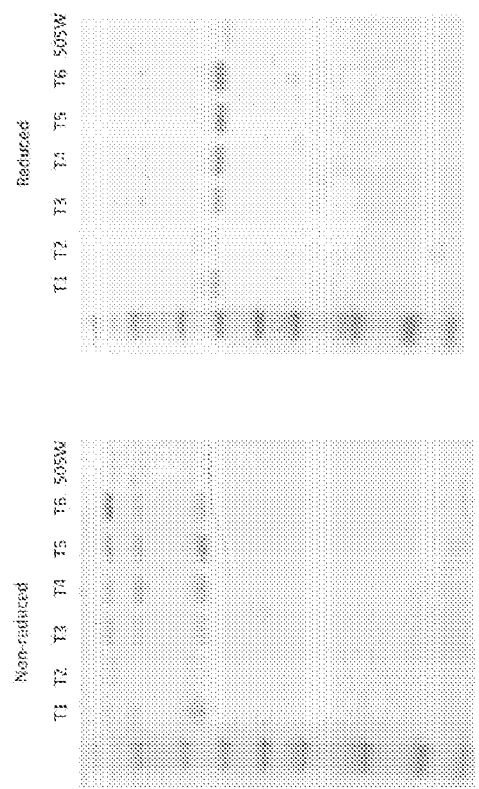
Figure 65:
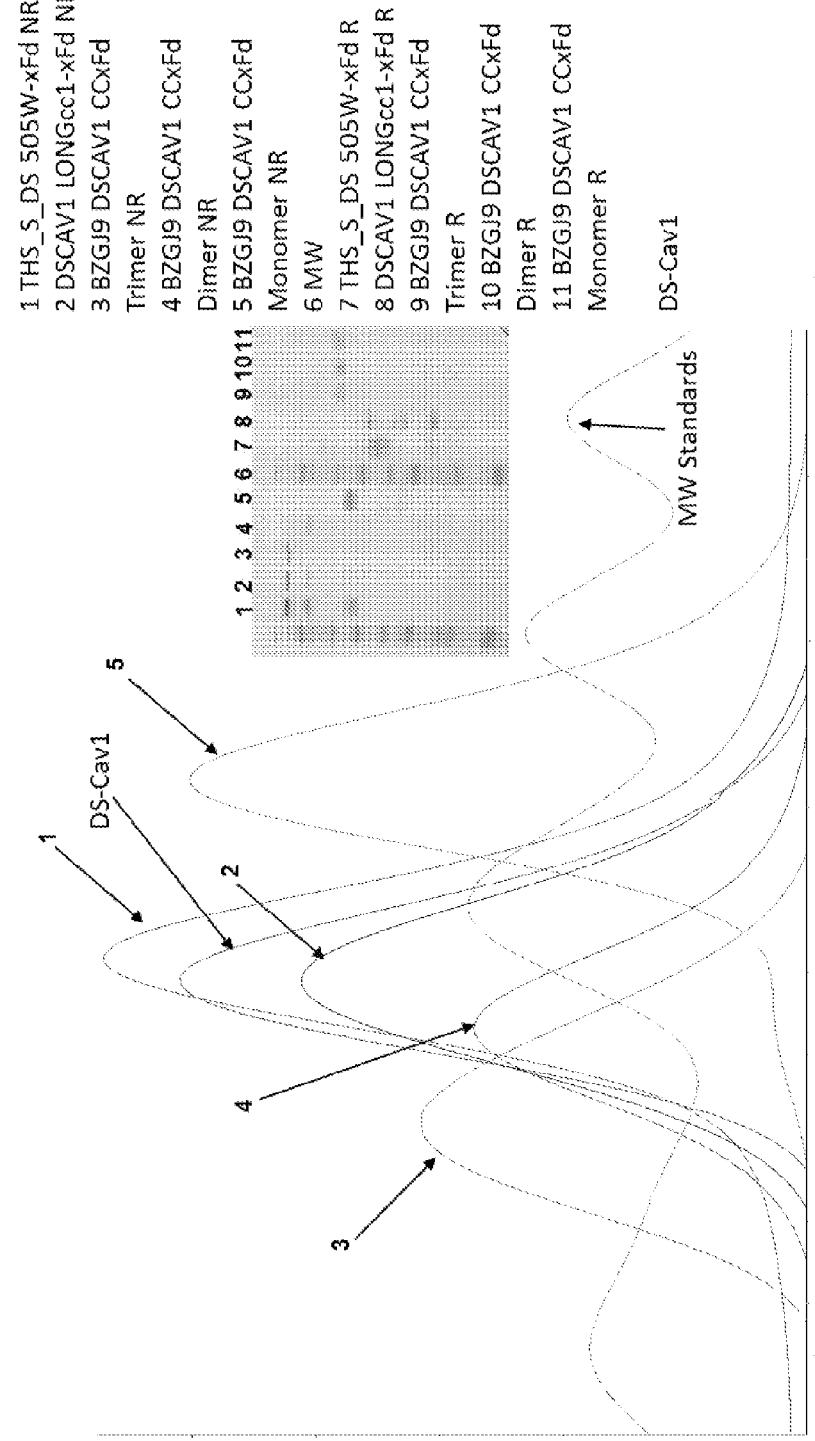

FIGS. 59A and 59B are a set of diagrams illustrating the three-dimensional structure of the RSV F protein from the B18537 strain with the DSCav1 mutations (SEQ ID NO: 372) (A) Cartoon representation of a protomer of RSV F. (B) Trimeric form of the fusion glycoprotein with the additional protomers shown in surface and ribbon representations.

FIGS. 60A-60D are a set of images illustrating the atomic level details of the RSV B18537 F glycoprotein with DSCav1 substitutions, and showing that the DSCav1 substitutions can be introduced into a RSV F glycoprotein B subtype to stabilize antigenic site Ø. (A) DS-Cav1 mutations are highlighted. (B) Antigenic site Ø located at the apex of the trimer is shown in stick representation in dark grey. (C) The interaction between the fusion peptide and β strands 15, 16 and 19 to form and inter-protomeric elongated sheet. (D) Interaction between the F2 C-terminus and the fusion peptide.

Figure 61B:
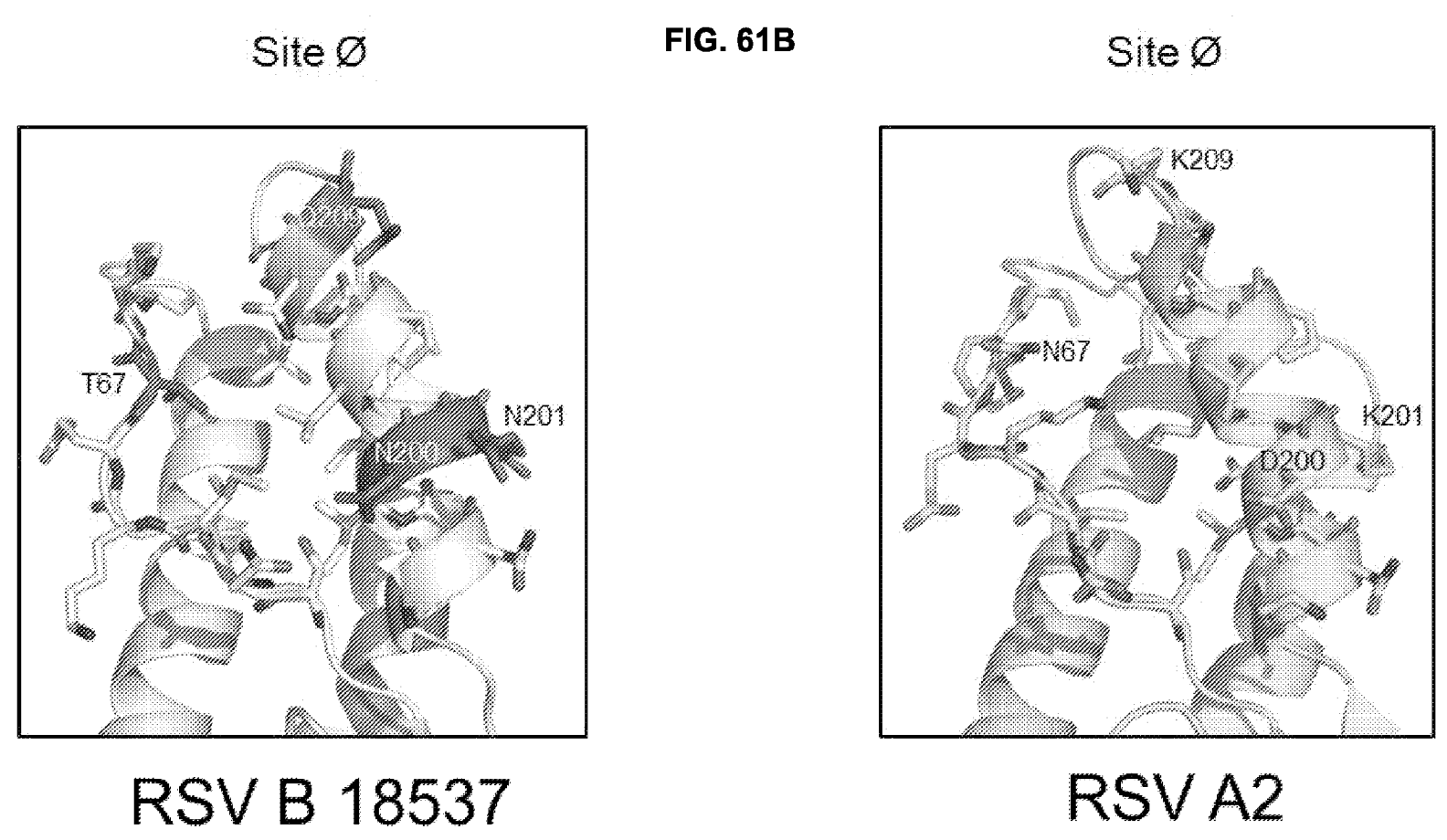

FIGS. 61A and 61B are a set of graphs and digital images illustrating antigenic characterization of RSV B18537 Fusion glycoprotein with DSCav1 substitutions. (A) Biolayer Interferometry measurements of prototypic site-specific antibodies were carried out by serial dilution of each Fab molecule and the association and dissociation rates to immobilized B18537 F DSCav1 proteins measured. (B) Structural comparison of antigenic site Ø from strain B18537 and A2. Surface exposed residues that differ between the two strains are labelled.

FIGS. 62A and 62B are graphs illustrating purification of the RSV strain B18537 F protein with DSCav1. A. SDS-PAGE of the elution fraction (reduced and non-reduced) and flowthrough fraction after StrepTagII affinity purification. B. Gel filtration of RSV B18537 F glycoprotein in GFB buffer on a 120 ml Superdex-200 size-exclusion column.

FIGS. 63-68 illustrate design and production of trimeric recombinant RSV F proteins stabilized in a prefusion conformation without a C-terminal trimerization domain to maintain stability of the membrane proximal lobe of RSV F. In place of the C-terminal trimerization domain, a ring of disulfide bonds is introduced into the C-terminus of the F1 polypeptide by substituting cysteine residues for amino acids of the α10 helix.

FIGS. 69A-69E are a set of tables showing ELISA data for the indicated recombinant RSV F variants. Expression and antigenic stability of RSV F variants (SEQ ID NOs: 859-1018). DNA encoding these RSV F variants was transfect into cell in the 96-well format under conditions where the recombinant RSV F proteins are secreted from the cells into the cell media. Each construct contains a leader sequence that causes the protein to enter the secretory system and be secreted. The medium was then centrifuged and the supernatant used for antigenicity testing for binding to the Site Ø specific antibody D25 and the Site II specific antibody Motavizumab ("Mota", FIGS. 69A-69E). The conditions tested include D25 and Mota binding on day 0 (conditions 1 and 2), D25 and Mota binding on day 0 after incubation at 70° C. for one hour (conditions 3 and 4), and D25 and Mota binding after 1 week at 4° C. (conditions 5 and 6). The control is the DSCav1 construct with a foldon domain. Specific antigenicity data for each construct is provided in FIGS. 69A-69E, with the conditions tested are noted in the header rows.

FIGS. 70A-70E are a set of schematic diagrams illustrating different design strategies to generate RSV F Antigenic Site Ø Immunogens. Antigenic site Ø includes the D25 recognition site on the outer surface of pre-fusion RSV F helix α4 and the loop just N-terminal to helix α1 of each protomer. Five methods were used to present isolated Site Ø epitopes on the surface of an immunogen: A) circular permutation (i.e. altering secondary structure linkers to alter the connectivity of site Ø segments for reasons of design ease and stability), B) incorporation of site Ø into a small scaffold protein, C) trimerization of circular permutations or scaffolded site Ø to match the native site Ø trimerization observed in the pre-fusion RSV F context (as in the left panel), D) including all of domain III for added stability of the site Ø fold and E) incorporation of A-D onto a nanoparticle platform for added immunogenicity.

FIG. 71 is a summary of the minimal site Ø immunogens that were designed, produced and tested for antigenicity to the site Ø specific antibodies D25, AN22 and 5C4 by ELISA under the indicated conditions. The table shows the number of site Ø immunogens that fall within each design category, and which produced an ELISA result of at least 1.5.

FIGS. 72A-72F are a set of tables showing ELISA data for the indicated minimal site Ø constructs binding to D25, AN22 or 5C4 antibody. The conditions tested include D25 binding after 0 and 1 week at 4° C. (condition 1) and 2), D25 binding after 1 hr. at 60° C. (condition 3), 70° C. (condition 4), 80° C. (condition 5), 90° C. (condition 6), or 100° C. (condition 7), AM22 binding after two weeks at 4° C. (condition 8), 5C4 binding at week 0 (condition 9). The average of D25, AM22, and D25 binding after 1 hour at 70°

C. is also shown (condition 10). ELISA scores of >1.5 are highlighted in dark grey; scores of 0.5-1.5 are highlighted in light grey.

Figure 73:
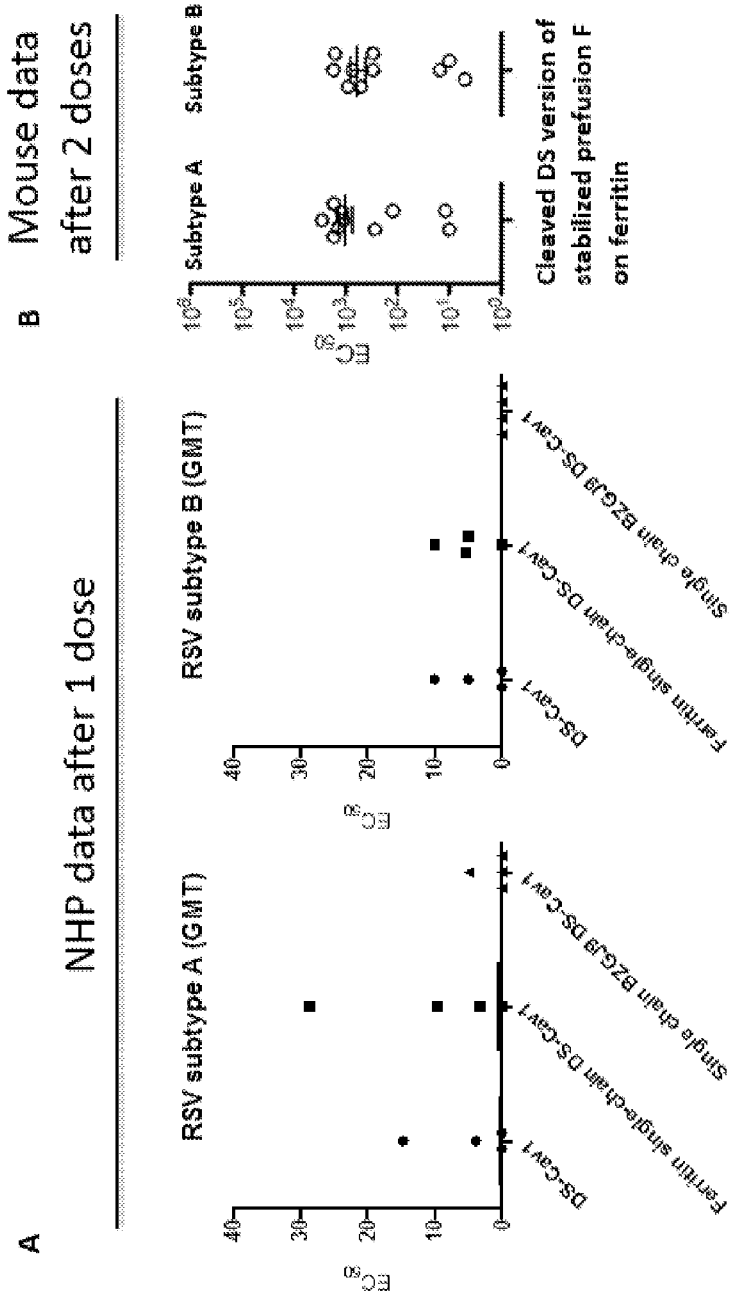
Figure 74:
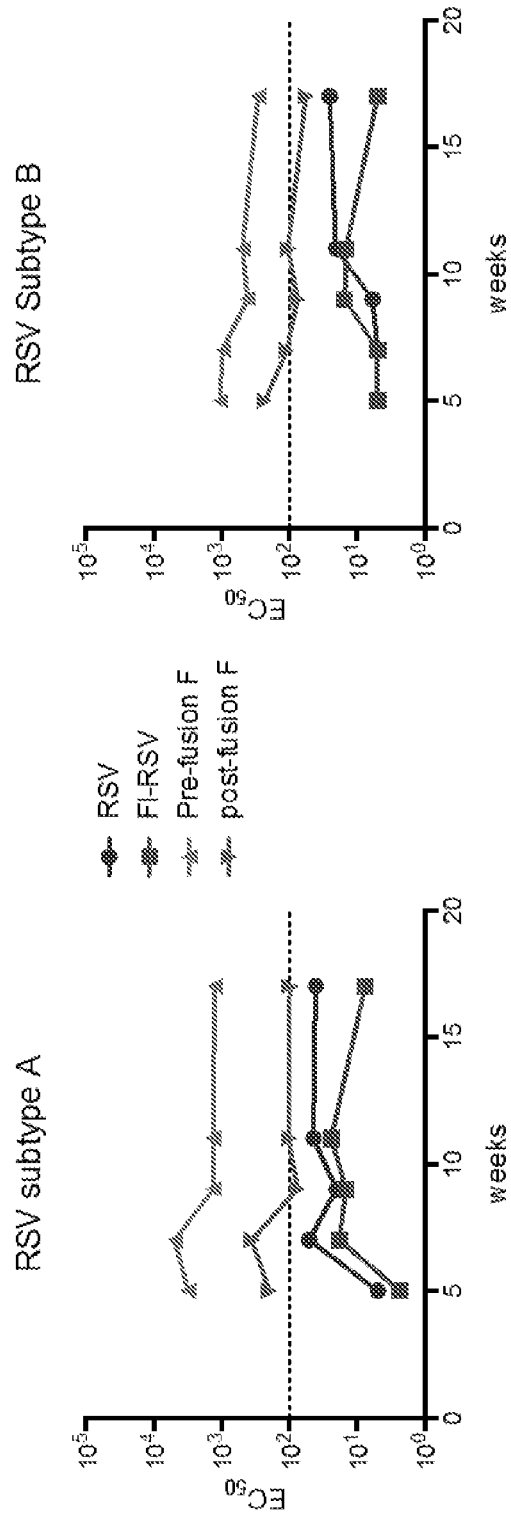

FIG. 73 is a set of graphs illustrating that immunization with DS version of stabilized prefusion F subtype A or B or both is induces neutralizing activity against both subtypes FIG. 74 is a set of graphs illustrating that DSCav1 antibody response is durable in mice after two doses with immunization at weeks 0 and 4.

Figure 75:
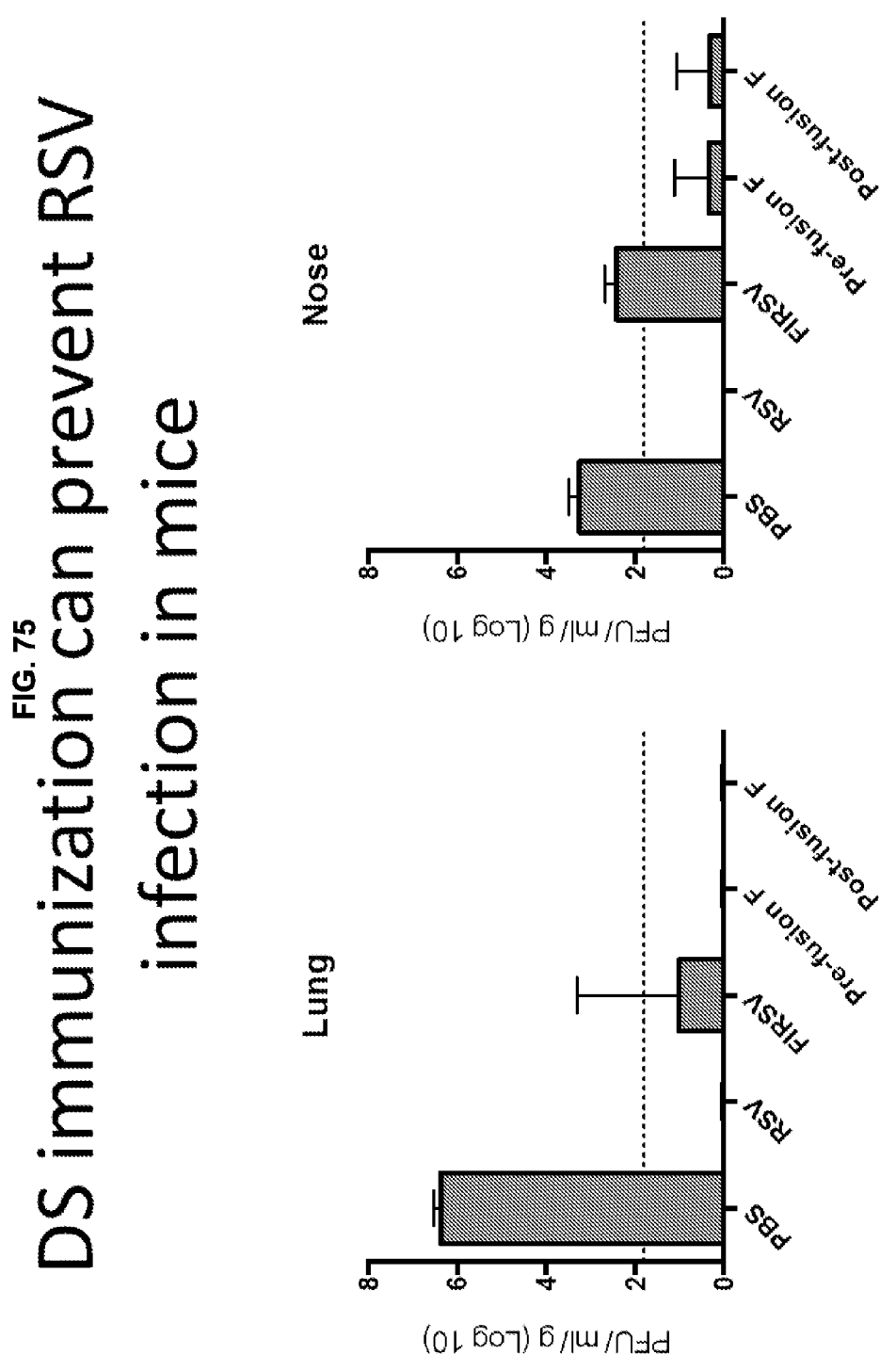

FIG. 75 is a set of graphs illustrating that DS immunization can prevent RSV infection in mice.

Figure 76:
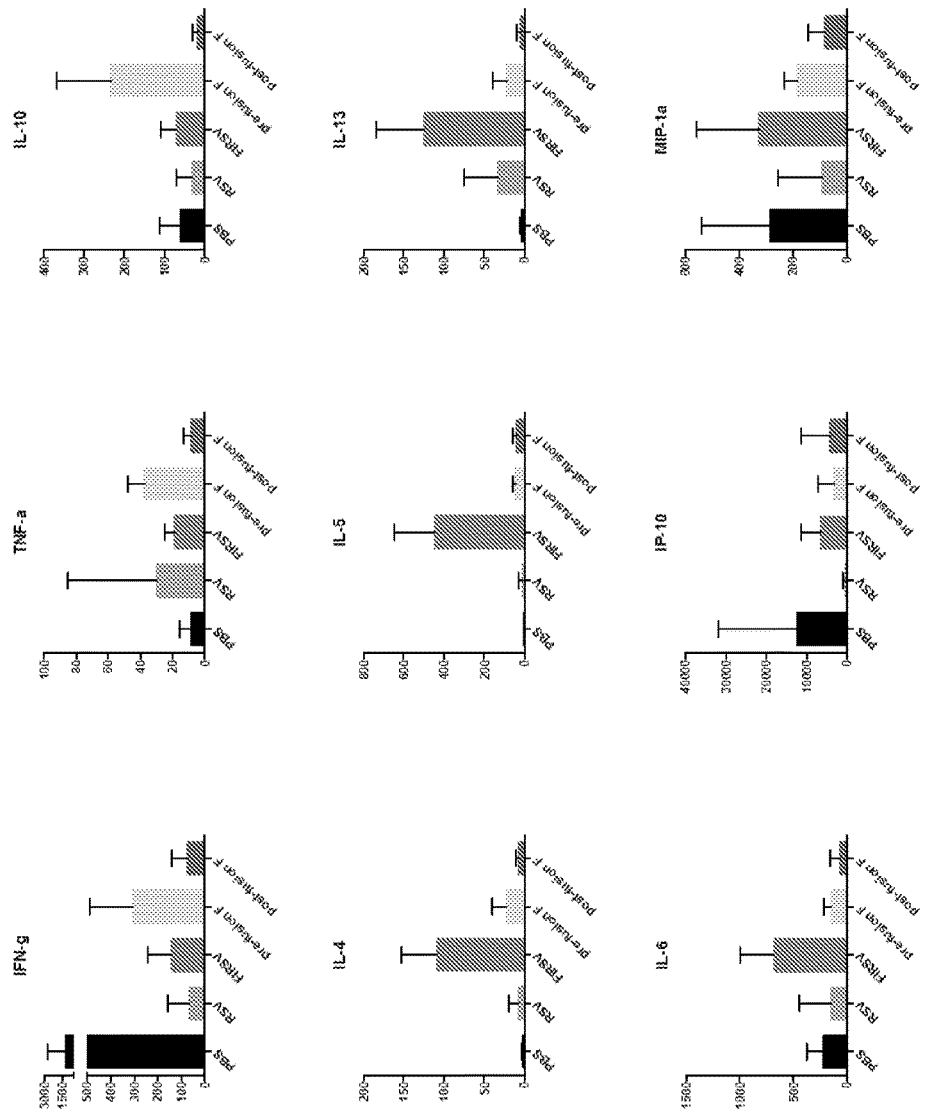

FIG. 76 is a set of graphs illustrating that DS immunization does not induce Type 2 cytokine responses in mice post-challenge.

Figure 77:
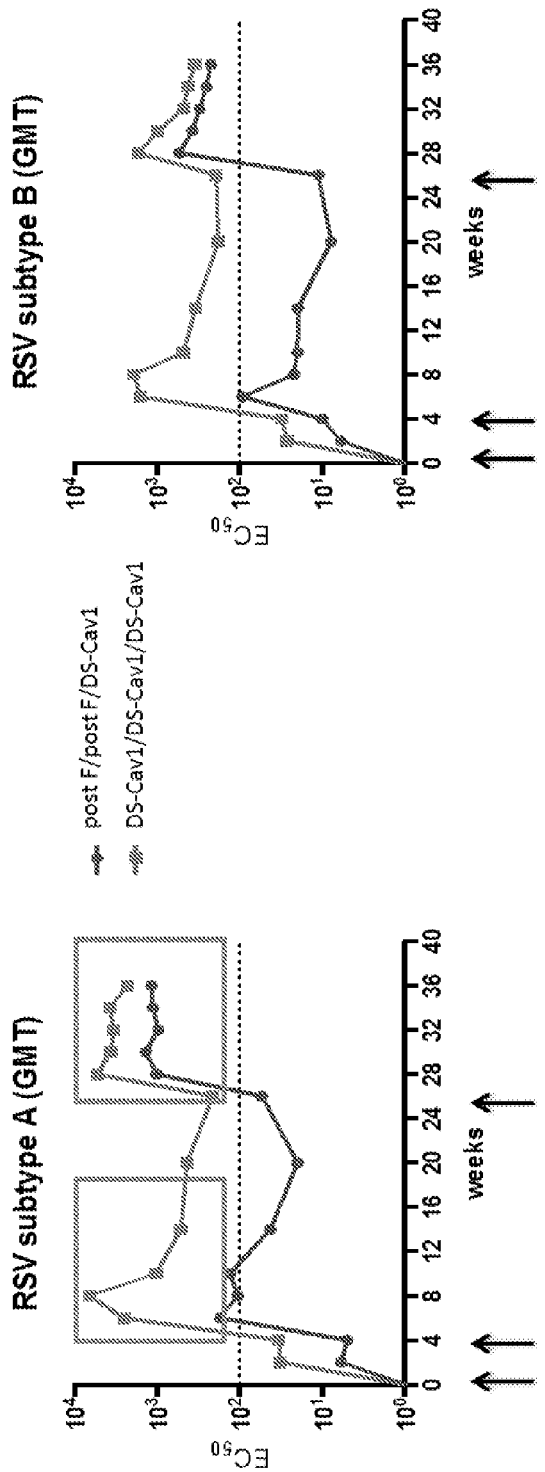

FIG. 77 is a set of graphs illustrating that the neutralizing immune response to DSCav1 is boosted and sustained after a $3^{rd}$ dose in non-human primates, which have been previously immunized with DS-Cav1 or DS at weeks 0 and 4.

FIG. 78 is a graph illustrating that DS-CAV1 can be effectively formulated in alum and retain immunogenicity.

FIG. 79 is a set of graphs illustrating that alum is an effective adjuvant for DSCav1 in non-human primates.

FIG. 80 is a graph illustrating that DS-CAV1 is immunogenic when expressed from a gene-based vector either alone or as priming for a protein boost.

Figure 81:
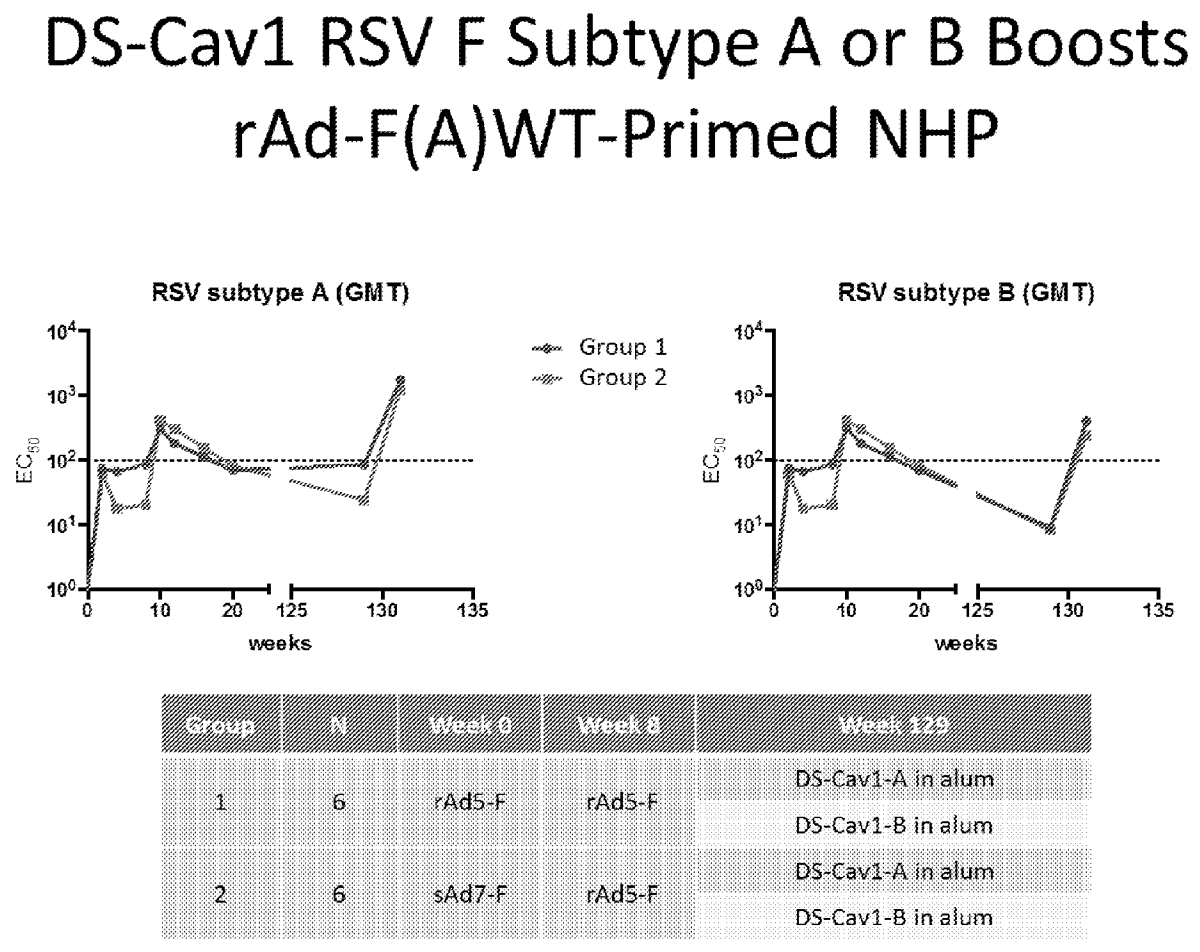

FIG. 81 is a set of graphs and a table illustrating that DS-Cav1 RSV F Subtype A or B can boost a prime immunization using gene base delivery of wildtype F protein in non-human primates.

Figure 82:
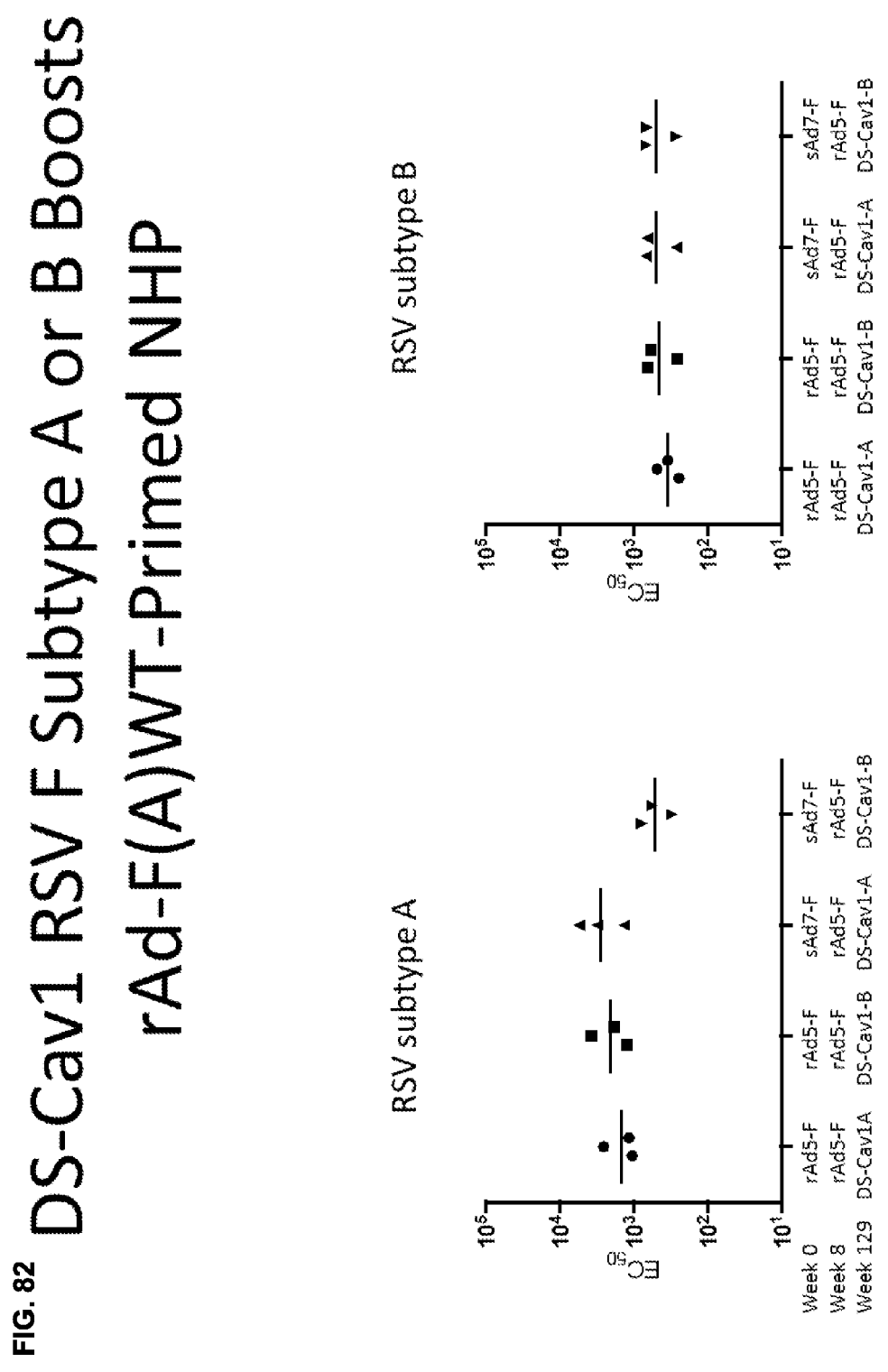

FIG. 82 is a set of graphs illustrating that DS-Cav1 RSV F Subtype A or B can boosts rAd-F(A)WT-primed non-human primate.

FIG. 83 is a set of graphs illustrating that immunization with the DS version of stabilized prefusion F subtype A or B or both is induces neutralizing activity against both subtypes of RSV.

FIG. 84 is a graph illustrating that altering glycosylation reduces immunogenicity of stabilized prefusion F.

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~3.2 MB), which was created on Sep. 11, 2015, and is incorporated by reference herein. In the accompanying Sequence Listing:

SEQ ID NOs: 1-128 are the amino acid sequences of native RSV F proteins from RSV type A.

SEQ ID NOs: 129-177 are the amino acid sequences of native RSV F proteins from RSV type B.

SEQ ID NOs: 178-184 are the amino acid sequences of native RSV F proteins from bovine RSV.

SEQ ID NOs: 185-350 are the amino acid sequences of recombinant RSV F proteins.

SEQ ID NO: 351 is the amino acid sequence of a T4 fibritin Foldon domain.

SEQ ID NOs: 352 and 355-365 are amino acid sequences of peptide linkers.

SEQ ID NO: 353 is the amino acid sequence of a *Helicobacter pylori* ferritin protein (GENBANK® Accession No. EJB64322.1, incorporated by reference herein as present in the database on Feb. 28, 2013).

SEQ ID NO: 354 is the amino acid sequence of an encapsulin protein (GENBANK® Accession No. YP_001738186.1, incorporated by reference herein as present in the database on Feb. 28, 2013).

SEQ ID NOs: 366 and 367 are the $V_H$ and $V_L$ amino acid sequences of the AM22 mAb, respectively.

SEQ ID NO: 368 and 369 are the $V_H$ and $V_L$ amino acid sequences of the D25 mAb, respectively.

SEQ ID NO: 370 is a recombinant RSV $F_0$ protein variant amino acid sequence of the prototypical A2 strain (GENBANK accession No. P03420, incorporated by reference herein as present in the database on Feb. 28, 2012), including P102A, I379V, and M447V substitutions compared to the P03420 sequence.

SEQ ID NO: 371 is the amino acid sequence of a recombinant RSV F protein from human subtype A including S155C, S290C, S190F and V207L amino acid substitutions, fused to a C-terminal Foldon domain, thrombin cleavage site, 6×His tag and a StrepTag II. The four mutated residues, and the C-terminal appendage are underlined.

MELLILKANAITTILTAVTFCFASGQNITEEFYQSTCSAVSKGYLSALRT

GWYTSVITIELSNIKENKCNGTDAKVKLIKQELDKYKNAVTELQLLMQST

PATNNRARRELPRFMNYTLNNAKKTNVTLSKKRKRRFLGFLLGVGSAIAS

GVAV<u>C</u>KVLHLEGEVNKIKSALLSTNKAVVSLSNGVSVLT<u>F</u>KVLDLKNYID

KQLLPI<u>L</u>NKQSCSISNIETVIEFQQKNNRLLEITREFSVNAGVTTPVSTY

MLTNSELLSLINDMPITNDQKKLMSNNVQIVRQQSYSIM<u>C</u>IIKEEVLAYV

VQLPLYGVIDTPCWKLHTSPLCTTNTKEGSNICLTRTDRGWYCDNAGSVS

FFPQAETCKVQSNRVFCDTMNSLTLPSEVNLCNVDIFNPKYDCKIMTSKT

DVSSSVITSLGAIVSCYGKTKCTASNKNRGIIKTFSNGCDYVSNKGVDTV

SVGNTLYYVNKQEGKSLYVKGEPIINFYDPLVFPSDEFDASISQVNEKIN

QSLAFIRKSDELL<u>SAIGGYIPEAPRDGQAYVRKDGEWVLLSTFLGGLVPR</u>

<u>GSHHHHHHSAWSHPQFEK</u> (RSV_A F(+)FdTHS DSCav1)

SEQ ID NO: 372 is the amino acid sequence of a recombinant RSV F protein from human subtype B including S155C, S290C, S190F and V207L amino acid substitutions, fused to a C-terminal Foldon domain, thrombin cleavage site, 6×His tag and a StrepTag II. The four mutated residues, and the C-terminal appendage are underlined.

MELLIHRLSAIFLTLAINALYLTSSQNITEEFYQSTCSAVSRGYFSALRT

GWYTSVITIELSNIKETKCNGTDTKVKLIKQELDKYKNAVTELQLLMQNT

PAANNRARREAPQYMNYTINTTKNLNVSISKKRKRRFLGFLLGVGSAIAS

GIAV<u>C</u>KVLHLEGEVNKIKNALLSTNKAVVSLSNGVSVLT<u>F</u>KVLDLKNYIN

NQLLPI<u>L</u>NQQSCRISNIETVIEFQQKNSRLLEINREFSVNAGVTTPLSTY

MLTNSELLSLINDMPITNDQKKLMSSNVQIVRQQSYSIM<u>C</u>IIKEEVLAYV

VQLPIYGVIDTPCWKLHTSPLCTTNIKEGSNICLTRTDRGWYCDNAGSVS

FFPQADTCKVQSNRVFCDTMNSLTLPSEVSLCNTDIFNSKYDCKIMTSKT

DISSSVITSLGAIVSCYGKTKCTASNKNRGIIKTFSNGCDYVSNKGVDTV

```
-continued
SVGNTLYYVNKLEGKNLYVKGEPIINYYDPLVFPSDEFDASISQVNEKIN

QSLAFIRRSDELLSAIGGYIPEAPRDGQAYVRKDGEWVLLSTFLGGLVPR

GSHHHHHHSAWSHPQFEK (RSV_B F(+)FdTHS DSCav1)
```

SEQ ID NO: 373 is the amino acid sequence of a recombinant RSV F protein from bovine RSV including S155C, S290C, S190F and V207L amino acid substitutions, fused to a C-terminal Foldon domain, thrombin cleavage site, 6×His tag and a StrepTag II. The four mutated residues, and the C-terminal appendage are underlined.

```
MAATAMRMIISIIFISTYMTHITLCQNITEEFYQSTCSAVSRGYLSALRT

GWYTSVVTIELSKIQKNVCKSTDSKVKLIKQELERYNNAVIELQSLMQNE

PASFSRAKRGIPELIHYTRNSTKRFYGLMGKKRKRRFLGFLLGIGSAIAS

GVAVCKVLHLEGEVNKIKNALLSTNKAVVSLSNGVSVLTFKVLDLKNYID

KELLPKLNNHDCRISNIETVIEFQQKNNRLLEIAREFSVNAGITTPLSTY

MLTNSELLSLINDMPITNDQKKLMSSNVQIVRQQSYSIMCVVKEEVIAYV

VQLPIYGVIDTPCWKLHTSPLCTTDNKEGSNICLTRTDRGWYCDNAGSVS

FFPQAETCKVQSNRVFCDTMNSLTLPTDVNLCNTDIFNTKYDCKIMTSKT

DISSSVITSIGAIVSCYGKTKCTASNKNRGIIKTFSNGCDYVSNKGVDTV

SVGNTLYYVNKLEGKALYIKGEPIINYYDPLVFPSDEFDASIAQVNAKIN

QSLAFIRRSDELLSAIGGYIPEAPRDGQAYVRKDGEWVLLSTFLGGLVPR

GSHHHHHHSAWSHPQFEK (bRSV F(+)FdTHS DSCav1)
```

SEQ ID NO: 374 is the amino acid sequence of a recombinant RSV F protein from human subtype A including S155C, S290C, and S190F amino acid substitutions, fused to a C-terminal Foldon domain, thrombin cleavage site, 6×His tag and a StrepTag II. The three mutated residues, and the C-terminal appendage are underlined.

SEQ ID NO: 375 is the amino acid sequence of a recombinant RSV F protein from human subtype B including S155C, S290C, and S190F amino acid substitutions, fused to a C-terminal Foldon domain, thrombin cleavage site, 6×His tag and a StrepTag II (RSV_B F(+)FdTHS DSS190F)

SEQ ID NO: 376 is the amino acid sequence of a recombinant RSV F protein from bovine RSV including S155C, S290C, and S190F amino acid substitutions, fused to a C-terminal Foldon domain, thrombin cleavage site, 6×His tag and a StrepTag II. (bRSV F(+)FdTHS DSS190F)

SEQ ID NO: 377 is the amino acid sequence of a recombinant RSV F protein from RSV A including S155C, S290C, S190F, V207L amino acid substitutions, fused to a C-terminal ferritin domain. (RSV_A F(+)FdTHS DSCav1 Ferritin)

SEQ ID NO: 378 is the amino acid sequence of a recombinant RSV F protein from RSV B including S155C, S290C, S190F, V207L amino acid substitutions, fused to a C-terminal ferritin domain. (RSV_B F(+)FdTHS DSCav1 ferritin)

SEQ ID NO: 379 is the amino acid sequence of a recombinant RSV F protein from bRSV including S155C, S290C, S190F, V207L amino acid substitutions, fused to a C-terminal ferritin domain. (bRSV F(+)FdTHS DSCav1 ferritin)

SEQ ID NO: 380 is the amino acid sequence of a recombinant RSV F protein from RSV A including S155C, S290C, S190F amino acid substitutions, fused to a C-terminal ferritin domain. (RSV_A F(+)FdTHS DSS190F Ferritin)

SEQ ID NO: 381 is the amino acid sequence of a recombinant RSV F protein from RSV B including S155C, S290C, S190F amino acid substitutions, fused to a C-terminal ferritin domain. (RSV_B F(+)FdTHS DSS190F ferritin)

SEQ ID NO: 382 is the amino acid sequence of a recombinant RSV F protein from bRSV including S155C, S290C, S190F amino acid substitutions, fused to a C-terminal ferritin domain. (bRSV F(+)FdTHS DSS190F ferritin)

SEQ ID NO: 383 is an exemplary nucleotide sequence encoding a recombinant RSV F protein from human subtype A including S155C, S290C, S190F and V207L amino acid substitutions, fused to a C-terminal Foldon domain, thrombin cleavage site, 6×His tag and a StrepTag II (DNA encoding RSV_A F(+)FdTHS DSCav1 expressed from VRC3798).

SEQ ID NO: 384 is a nucleotide sequence of an expression vector for expressing recombinant RSV F protein from human subtype A including S155C, S290C, S190F and V207L amino acid substitutions, fused to a C-terminal Foldon domain, thrombin cleavage site, 6×His tag and a StrepTag II (RSV_A F(+)FdTHS DSCav1 paH vector; VRC3798).

SEQ ID NO: 385 is an exemplary nucleotide sequence encoding a recombinant RSV F protein from human subtype B (strain B1) including S155C, S290C, S190F and V207L amino acid substitutions, fused to a C-terminal Foldon domain, thrombin cleavage site, 6×His tag and a StrepTag II (DNA encoding RSV_B (B1) F(+)FdTHS DSCav1; expressed from VRC3764).

SEQ ID NO: 386 is a nucleotide sequence of an expression vector for expressing recombinant RSV F protein from human subtype B (strain B1) including S155C, S290C, S190F and V207L amino acid substitutions, fused to a C-terminal Foldon domain, thrombin cleavage site, 6×His tag and a StrepTag II (RSV_B (B1) F(+)FdTHS DSCav1 paH vector; VRC3764).

SEQ ID NO: 387 is an exemplary nucleotide sequence encoding a recombinant RSV F protein from human subtype B (Strain 18537) including S155C, S290C, S190F and V207L amino acid substitutions, fused to a C-terminal Foldon domain, thrombin cleavage site, 6×His tag and a StrepTag II (DNA encoding RSV_B F(+)FdTHS DSCav1; expressed from VRC3799).

SEQ ID NO: 388 is a nucleotide sequence of an expression vector for expressing recombinant RSV F protein from human subtype B (Strain 18537) including S155C, S290C, S190F and V207L amino acid substitutions, fused to a C-terminal Foldon domain, thrombin cleavage site, 6×His tag and a StrepTag II (RSV_B F(+)FdTHS DSCav1 paH vector; VRC3799).

SEQ ID NOs: 389-693 are the amino acid sequences of recombinant RSV F proteins stabilized in a prefusion conformation.

SEQ ID NOs: 694-697 are the amino acid sequences of modified Foldon domain polypeptides.

SEQ ID NOs: 698-697 are the amino acid sequences of modified Foldon domain polypeptides.

SEQ ID NOs: 698-828, 1429-1442 and 1474-1478 are the amino acid sequences of single chain recombinant RSV F proteins.

SEQ ID NOs: 829-1025 and 1456-1468 are the amino acid sequences of recombinant RSV F proteins linked to a cleavable foldon domain, or not linked to a foldon domain.

SEQ ID NO: 1026 is the amino acid sequence of a RSV F protein without prefusion-stabilizing substitutions.

SEQ ID NOs: 901-968 are the amino acid sequences of recombinant RSV F proteins stabilized in a prefusion conformation.

SEQ ID NOs: 1027-1088 and 1099-1428 are the amino acid sequences of minimal site Ø immunogens that are described in Example 14.

STRUCTURAL COORDINATES

The atomic coordinates of the crystal structure of RSV F protein bound by D25 Fab are recited in Table 1 of U.S. Provisional Application No. 61/780,910, filed Mar. 13, 2013, which is incorporated by reference herein in its entirety. These atomic coordinates of the crystal structure of RSV F protein bound by D25 Fab are also deposited as Protein Data Bank Accession No. 4JHW, and which is incorporated by reference herein as present in that database on May 1, 2013.

DETAILED DESCRIPTION

The RSV F glycoprotein it is a type I fusion protein that facilitates fusion of viral and cellular membranes (Walsh and Hruska, *J. Virol.*, 47, 171 (1983)). After initial synthesis, RSV F adopts a metastable prefusion conformation that stores folding energy, which is released during a structural rearrangement to a highly stable postfusion conformation after contact with host cell membranes. Three antigenic sites (I, II, and IV) on RSV F protein have been found to elicit neutralizing activity (Arbiza et al., *J. Gen. Virol.*, 73, 2225 (1992); Lopez et al., *J. Virol.*, 72, 6922 (1998); López et al., *J. Virol.*, 64, 927 (1990)), and all exist on the postfusion form of RSV F protein as determined by structural and biophysical studies (McLellan et al., *J. Virol.*, 85, 7788 (2011); Swanson et al., *Proc. Natl. Acad. Sci. U.S.A.*, 108, 9619 (2011)). Absorption of human sera with postfusion RSV F, however, fails to remove the majority of F-specific neutralizing activity, suggesting that the prefusion form of RSV F harbors novel neutralizing antigenic sites (Magro et al., *Proc. Natl. Acad. Sci. U.S.A.*, 109, 3089 (2012)).

Prior to the work disclosed herein, a homogeneous preparation of soluble prefusion RSV F protein was unavailable, precluding determination of the prefusion F structure and identification of novel prefusion F-specific antigenic sites. As described herein, RSV F protein specific antibodies were identified that neutralize RSV, but do not specifically bind to postfusion RSV F, and the three-dimensional structure of prefusion F, recognized by these antibodies, was obtained. The results provided herein reveal for the first time the prefusion conformation of RSV F and the mechanism of neutralization for a category of remarkably potent RSV prefusion F neutralizing antibodies. Using the three-dimensional structure of prefusion F as a guide, stabilized forms of prefusion F ("PreF" antigens) were constructed and used to generate RSV neutralizing immune responses many fold greater than that achieved with prior RSV F protein-based immunogens.

I. TERMS

Unless otherwise noted, technical terms are used according to conventional usage. Definitions of common terms in molecular biology can be found in Benjamin Lewin, *Genes VII*, published by Oxford University Press, 1999; Kendrew et al. (eds.), *The Encyclopedia of Molecular Biology*, published by Blackwell Science Ltd., 1994; and Robert A. Meyers (ed.), *Molecular Biology and Biotechnology: a Comprehensive Desk Reference*, published by VCH Publishers, Inc., 1995; and other similar references.

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen." As used herein, the term "comprises" means "includes." Thus, "comprising an antigen" means "including an antigen" without excluding other elements. It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described herein. In case of conflict, the present specification, including explanations of terms, will control. In addition, the materials, methods, and examples are illustrative only and not intended to be limiting. To facilitate review of the various embodiments, the following explanations of terms are provided:

5C4: A neutralizing monoclonal antibody that specifically binds to the prefusion conformation of the RSV F protein, but not to the post fusion conformation of RSV F protein. The 5C4 antibody include heavy and light chain variable regions with the amino acid sequences set forth as SEQ ID NOs: 1470 and 1471, respectively. As described in McLellan et al., *Science*, 340(6136):1113-7, 2013, 5C4 specifically binds to a quaternary epitope found on the RSV F protein in its prefusion conformation, but not the post fusion conformation. In several embodiments, antibody 5C4 specifically binds to the PreF antigens disclosed herein.

5C4 Heavy Chain Variable Domain:

(SEQ ID NO: 1470)
EVQLQQSGAELVKPGASVKLSCTASGENIKDTFFHWVKQRPEQGLEWIGR

IDPADGHTKYDPKFQGKATITADTSSNTAFLQLSSLTSVDTAVYYCATTI

TAVVPTPYNAMDYWGQGTSVTVSS

5C4 Kappa Light Chain Variable Domain:

(SEQ ID NO: 1471)
DIVLIQSPASLAVSLGQRTTISCRASESVDSEDNSFIHWYQQKPGQPPKL

LIFLASSLESGVPARFSGSGSRTDFTLTIDPVEADDAATYYCQQSNEDPF

TFGSGTKLEIK

Adjuvant: A vehicle used to enhance antigenicity. Adjuvants include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages) Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL and toll-like receptor (TLR) agonists, such as TLR-9 agonists. The person of ordinary skill in the art is familiar with adjuvants (see, e.g., Singh (ed.) Vaccine Adjuvants and Delivery Systems. Wiley-Interscience, 2007). Adjuvants can be used in combination with the disclosed PreF antigens.

Administration: The introduction of a composition into a subject by a chosen route. Administration can be local or systemic. For example, if the chosen route is intravenous, the composition (such as a composition including a disclosed immunogen) is administered by introducing the composition into a vein of the subject.

Agent: Any substance or any combination of substances that is useful for achieving an end or result; for example, a substance or combination of substances useful for inhibiting RSV infection in a subject. Agents include proteins, nucleic acid molecules, compounds, small molecules, organic compounds, inorganic compounds, or other molecules of interest, such as viruses, such as recombinant viruses. An agent can include a therapeutic agent (such as an anti-RSV agent), a diagnostic agent or a pharmaceutical agent. In some embodiments, the agent is a polypeptide agent (such as an immunogenic RSV polypeptide), or an anti-viral agent. The skilled artisan will understand that particular agents may be useful to achieve more than one result.

AM22: A neutralizing monoclonal antibody that specifically binds to the prefusion conformation of the RSV F protein, but not the post fusion conformation of RSV F protein. AM22 protein and nucleic acid sequences are known, for example, the heavy and light chain amino acid sequences of the AM22 antibody are set forth in U.S. Pat. App. Pub. No. 2012/0070446, which is incorporated herein in its entirety). As described in Example 1, AM22 specifically binds to an epitope (included on antigenic site Ø) including positions found on the RSV F protein in its prefusion conformation, but not the post fusion conformation. This epitope is included within RSV F positions 62-69 and 196-209, and located at the membrane distal apex of the RSV F protein in the prefusion conformation (see, e.g., FIGS. 2B and 9A). Prior to this disclosure it was not known that AM22 was specific for the prefusion conformation. In several embodiments, antibody AM22 specifically binds to the PreF antigens disclosed herein.

Amino acid substitutions: The replacement of one amino acid in an antigen with a different amino acid or a deletion of an amino acid. In some examples, an amino acid in an antigen is substituted with an amino acid from a homologous protein.

Animal: A living multi-cellular vertebrate or invertebrate organism, a category that includes, for example, mammals. The term mammal includes both human and non-human mammals. Similarly, the term "subject" includes both human and veterinary subjects, such as non-human primates. Thus, administration to a subject can include administration to a human subject. Non-limiting examples of veterinary subjects include domesticated animals (such as cats and dogs), livestock (for example, cattle, horses, pigs, sheep, and goats), and laboratory animals (for example, mice, rabbits, rats, gerbils, guinea pigs, and non-human primates).

Antibody: A polypeptide that in nature is substantially encoded by an immunoglobulin gene or immunoglobulin genes, or fragments thereof, which specifically binds and recognizes an analyte (such as an antigen or immunogen) such as a RSV F protein or antigenic fragment thereof. Immunoglobulin genes include the kappa, lambda, alpha, gamma, delta, epsilon and mu constant region genes, as well as the myriad immunoglobulin variable region genes. The term "antibody," as used herein, includes antibody fragments produced, for example, by the modification of whole antibodies and by de novo synthesis using recombinant DNA methodologies.

Antibodies exist, for example, as intact immunoglobulins and as a number of well characterized antibody fragments. For instance, Fabs, Fvs, and single-chain Fvs (SCFvs) that bind to RSV F protein, would be RSV F protein-specific binding agents. This includes intact immunoglobulins and the variants and portions of them well known in the art, such as Fab' fragments, F(ab)'2 fragments, single chain Fv proteins ("scFv"), and disulfide stabilized Fv proteins ("dsFv"). A scFv protein is a fusion protein in which a light chain variable region of an immunoglobulin and a heavy chain variable region of an immunoglobulin are bound by a linker, while in dsFvs, the chains have been mutated to introduce a disulfide bond to stabilize the association of the chains. The term also includes genetically engineered forms such as chimeric antibodies (such as humanized murine antibodies), heteroconjugate antibodies (such as bispecific antibodies). See also, *Pierce Catalog and Handbook,* 1994-1995 (Pierce Chemical Co., Rockford, Ill.); Kuby, J., *Immunology,* $3^{rd}$ Ed., W.H. Freeman & Co., New York, 1997.

Antibody fragments are defined as follows: (1) Fab, the fragment which contains a monovalent antigen-binding fragment of an antibody molecule produced by digestion of whole antibody with the enzyme papain to yield an intact light chain and a portion of one heavy chain; (2) Fab', the fragment of an antibody molecule obtained by treating whole antibody with pepsin, followed by reduction, to yield an intact light chain and a portion of the heavy chain; two Fab' fragments are obtained per antibody molecule; (3) (Fab')2, the fragment of the antibody obtained by treating whole antibody with the enzyme pepsin without subsequent reduction; (4) F(ab')2, a dimer of two Fab' fragments held together by two disulfide bonds; (5) Fv, a genetically engineered fragment containing the variable region of the light chain and the variable region of the heavy chain expressed as two chains; and (6) single chain antibody ("SCA"), a genetically engineered molecule containing the variable region of the light chain, the variable region of the heavy chain, linked by a suitable polypeptide linker as a genetically fused single chain molecule.

Typically, a naturally occurring immunoglobulin has heavy (H) chains and light (L) chains interconnected by disulfide bonds. There are two types of light chain, lambda (λ) and kappa (κ). There are five main heavy chain classes (or isotypes) which determine the functional activity of an antibody molecule: IgM, IgD, IgG, IgA and IgE. The disclosed antibodies can be class switched.

Each heavy and light chain contains a constant region and a variable region, (the regions are also known as "domains"). In several embodiments, the heavy and the light chain variable domains combine to specifically bind the antigen. In additional embodiments, only the heavy chain variable domain is required. For example, naturally occurring camelid antibodies consisting of a heavy chain only are functional and stable in the absence of light chain (see, e.g., Hamers-Casterman et al., *Nature,* 363:446-448, 1993; Sheriff et al., *Nat. Struct. Biol.,* 3:733-736, 1996). Light and heavy chain variable domains contain a "framework" region interrupted by three hypervariable regions, also called "complementarity-determining regions" or "CDRs" (see, e.g., Kabat et al., *Sequences of Proteins of Immunological Interest,* U.S. Department of Health and Human Services, 1991). The sequences of the framework regions of different light or heavy chains are relatively conserved within a species. The framework region of an antibody, that is the combined framework regions of the constituent light and heavy chains, serves to position and align the CDRs in three-dimensional space.

The CDRs are primarily responsible for binding to an epitope of an antigen. The amino acid sequence boundaries of a given CDR can be readily determined using any of a number of well-known schemes, including those described by Kabat et al. ("Sequences of Proteins of Immunological Interest," 5th Ed. Public Health Service, National Institutes of Health, Bethesda, Md., 1991; "Kabat" numbering scheme), Al-Lazikani et al., (JMB 273,927-948, 1997; "Chothia" numbering scheme), and Lefranc, et al. ("IMGT unique numbering for immunoglobulin and T cell receptor variable domains and Ig superfamily V-like domains," Dev. Comp. Immunol., 27:55-77, 2003; "IMGT" numbering scheme).

The CDRs of each chain are typically referred to as CDR1, CDR2, and CDR3 (from the N-terminus to C-terminus), and are also typically identified by the chain in which the particular CDR is located. Thus, a $V_H$ CDR3 is located in the variable domain of the heavy chain of the antibody in which it is found, whereas a $V_L$ CDR1 is the CDR1 from the variable domain of the light chain of the antibody in which it is found. Light chain CDRs are sometimes referred to as CDR L1, CDR L2, and CDR L3. Heavy chain CDRs are sometimes referred to as CDR H1, CDR H2, and CDR H3.

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous antigens, such as the disclosed recombinant RSV F proteins.

Examples of antigens include, but are not limited to, polypeptides, peptides, lipids, polysaccharides, combinations thereof (such as glycopeptides) and nucleic acids containing antigenic determinants, such as those recognized by an immune cell. In some examples, antigens include peptides derived from a pathogen of interest, such as RSV. In specific examples, an antigen is derived from RSV, such as an antigen including a modified RSV F protein stabilized in a prefusion conformation. "Epitope" or "antigenic determinant" refers to the region of an antigen to which B and/or T cells respond.

Anti-RSV agent: An agent that specifically inhibits RSV from replicating or infecting cells. Non-limiting examples of anti-RSV agents include the monoclonal antibody palivizumab (SYNAGIS®; Medimmune, Inc.) and the small molecule anti-viral drug ribavirin (manufactured by many sources, e.g., Warrick Pharmaceuticals, Inc.).

Atomic Coordinates or Structure coordinates: Mathematical coordinates derived from mathematical equations related to the patterns obtained on diffraction of a monochromatic beam of X-rays by the atoms (scattering centers) such as an antigen, or an antigen in complex with an antibody. In some examples that antigen can be RSV F protein (for example stabilized in a prefusion conformation by binding to a prefusion-specific antibody, or by introduction of stabilizing modifications) in a crystal. The diffraction data are used to calculate an electron density map of the repeating unit of the crystal. The electron density maps are used to establish the positions of the individual atoms within the unit cell of the crystal. In one example, the term "structure coordinates" refers to Cartesian coordinates derived from mathematical equations related to the patterns obtained on diffraction of a monochromatic beam of X-rays, such as by the atoms of a RSV F protein in crystal form.

Those of ordinary skill in the art understand that a set of structure coordinates determined by X-ray crystallography is not without standard error. For the purpose of this disclosure, any set of structure coordinates that have a root mean square deviation of protein backbone atoms (N, Cα, C and O) of less than about 1.0 Angstroms when superimposed, such as about 0.75, or about 0.5, or about 0.25 Angstroms, using backbone atoms, shall (in the absence of an explicit statement to the contrary) be considered identical.

Cavity-filling amino acid substitution: An amino acid substitution that fills a cavity within the protein core of the RSV F protein, for example a cavity present in a protomer of the RSV F protein, or a cavity between protomers of the RSV F protein. Cavities are essentially voids within a folded protein where amino acids or amino acid side chains are not present. In several embodiments, a cavity filling amino acid substitution is introduced to fill a cavity in the RSV F protein core present in the RSV F protein prefusion conformation that collapse (e.g., have reduced volume) after transition to the postfusion conformation.

Circular Permutant: A modified recombinant protein in which the connections between different regions of a protein tertiary structure is modified, so that the relative order of different regions in the primary sequence is altered, but the placement of the regions in the tertiary structure is preserved. For example, with a 4-stranded antiparallel sheet, with strand A, B, C and D, which has the following N and C termini and connectivity, Nterm-strand A-linker-strand B-linker-strand C-linker-strand D-Cterm, circular permutants of the 4 strands, A, B, C and D by altering linker connection between strands would include Permutation with N- and C-termini altered:

Nterm-strand C-linker-strand D-linker-strand A-linker-strand B-Cterm Permutation with N terminus preserved:

Nterm-strand A-linker-strand D-linker-strand C-linker-strand B-C term Permutation with C terminus preserved:

Nterm-strand C-linker-strand B-linker-strand A-linker-strand D-C term.

Contacting: Placement in direct physical association; includes both in solid and liquid form. Contacting includes contact between one molecule and another molecule, for example the amino acid on the surface of one polypeptide, such as an antigen, that contact another polypeptide, such as an antibody. Contacting also includes administration, such as administration of a disclosed antigen to a subject by a chosen route.

Control: A reference standard. In some embodiments, the control is a negative control sample obtained from a healthy patient. In other embodiments, the control is a positive control sample obtained from a patient diagnosed with RSV infection. In still other embodiments, the control is a historical control or standard reference value or range of values (such as a previously tested control sample, such as a group of RSV patients with known prognosis or outcome, or group of samples that represent baseline or normal values).

A difference between a test sample and a control can be an increase or conversely a decrease. The difference can be a qualitative difference or a quantitative difference, for example a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

D25: A neutralizing monoclonal antibody that specifically binds to the prefusion conformation of the RSV F protein, but not the post fusion conformation of RSV F protein. D25 protein and nucleic acid sequences are known, for example, the heavy and light chain amino acid sequences of the D25 antibody are set forth in U.S. Pat. App. Pub. No. 2010/0239593, which is incorporated herein in its entirety; see also, Kwakkenbos et al., *Nat. Med.,* 16:123-128, 2009). As described in Example 1, D25 specifically binds to a quaternary epitope (included on antigenic site Ø) found on the RSV F protein in its prefusion conformation, but not the post fusion conformation. This epitope is included within RSV F positions 62-69 and 196-209, and located at the membrane distal apex of the RSV F protein in the prefusion conformation (see, e.g., FIGS. 2B and 9A). Prior to this disclosure it was not known that D25 was specific for the prefusion conformation of RSV F protein). In several embodiments, antibody D25 specifically binds to the PreF antigens disclosed herein.

Degenerate variant and conservative variant: A polynucleotide encoding a polypeptide that includes a sequence that is degenerate as a result of the genetic code. For example, a polynucleotide encoding a disclosed antigen, or an antibody that specifically binds a disclosed antigen, that includes a sequence that is degenerate as a result of the genetic code. There are 20 natural amino acids, most of which are specified by more than one codon. Therefore, all degenerate nucleotide sequences are included as long as the amino acid sequence of the antigen or antibody that binds the antigen encoded by the nucleotide sequence is unchanged. Because of the degeneracy of the genetic code, a large number of functionally identical nucleic acids encode any given polypeptide. For instance, the codons CGU, CGC, CGA, CGG, AGA, and AGG all encode the amino acid arginine. Thus, at every position where an arginine is specified within a protein encoding sequence, the codon can be altered to any of the corresponding codons described without altering the encoded protein. Such nucleic acid variations are "silent variations," which are one species of conservative variations. Each nucleic acid sequence herein that encodes a polypeptide also describes every possible silent variation. One of skill will recognize that each codon in a nucleic acid (except AUG, which is ordinarily the only codon for methionine) can be modified to yield a functionally identical molecule by standard techniques. Accordingly, each "silent variation" of a nucleic acid which encodes a polypeptide is implicit in each described sequence.

One of ordinary skill will recognize that individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

Conservative amino acid substitutions providing functionally similar amino acids are well known in the art. The following six groups each contain amino acids that are conservative substitutions for one another:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Not all residue positions within a protein will tolerate an otherwise "conservative" substitution. For instance, if an amino acid residue is essential for a function of the protein, even an otherwise conservative substitution may disrupt that activity, for example the specific binding of an antibody to a target epitope may be disrupted by a conservative mutation in the target epitope.

Epitope: An antigenic determinant. These are particular chemical groups or peptide sequences on a molecule that are antigenic, such that they elicit a specific immune response, for example, an epitope is the region of an antigen to which B and/or T cells respond. An antibody binds a particular antigenic epitope, such as an epitope of a RSV F protein, for example, a D25 or AM22 epitope present on the prefusion conformation of the RSV F protein.

Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and nuclear magnetic resonance. Epitopes can also include post-translation modification of amino acids, such as N-linked glycosylation.

In one embodiment, T cells respond to the epitope, when the epitope is presented in conjunction with an MHC molecule. Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and nuclear magnetic resonance.

A "target epitope" is a particular epitope on an antigen that specifically binds an antibody of interest, such as a monoclonal antibody. In some examples, a target epitope includes the amino acid residues that contact the antibody of interest, such that the target epitope can be selected by the amino acid residues determined to be in contact with the antibody of interest.

Effective amount: An amount of agent, such as a PreF antigen or nucleic acid encoding a PreF antigen or other agent that is sufficient to generate a desired response, such as an immune response to RSV F protein, or a reduction or elimination of a sign or symptom of a condition or disease, such as RSV infection. For instance, this can be the amount necessary to inhibit viral replication or to measurably alter outward symptoms of the viral infection. In general, this amount will be sufficient to measurably inhibit virus (for example, RSV) replication or infectivity. When administered to a subject, a dosage will generally be used that will achieve target tissue concentrations (for example, in respiratory tissue) that has been shown to achieve in vitro inhibition of viral replication. In some examples, an "effective amount" is one that treats (including prophylaxis) one or more symptoms and/or underlying causes of any of a disorder or disease, for example to treat RSV infection. In one example, an effective amount is a therapeutically effective amount. In one example, an effective amount is an amount that prevents one or more signs or symptoms of a particular disease or condition from developing, such as one or more signs or symptoms associated with RSV infection.

Expression: Translation of a nucleic acid into a protein. Proteins may be expressed and remain intracellular, become a component of the cell surface membrane, or be secreted into the extracellular matrix or medium.

Expression Control Sequences: Nucleic acid sequences that regulate the expression of a heterologous nucleic acid sequence to which it is operatively linked. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

A polynucleotide can be inserted into an expression vector that contains a promoter sequence, which facilitates the efficient transcription of the inserted genetic sequence of the host. The expression vector typically contains an origin of replication, a promoter, as well as specific nucleic acid sequences that allow phenotypic selection of the transformed cells.

Ferritin: A protein that stores iron and releases it in a controlled fashion. The protein is produced by almost all living organisms. Ferritin assembles into a globular protein complex that in some cases consists of 24 protein subunits. In some examples, ferritin is used to form a nanoparticle presenting antigens on its surface, for example an RSV antigen, such as the disclosed RSV F protein antigens stabilized in a prefusion conformation.

Foldon domain: An amino acid sequence that naturally forms a trimeric structure. In some examples, a Foldon domain can be included in the amino acid sequence of a disclosed RSV F protein antigen stabilized in a prefusion conformation so that the antigen will form a trimer. In one example, a Foldon domain is the T4 Foldon domain set forth as SEQ ID NO: 351 (GYIPEAPRDGQAYVRKDGEWV-LLSTF). Several embodiments include a Foldon domain that can be cleaved from a purified protein, for example by incorporation of a thrombin cleave site adjacent to the Foldon domain that can be used for cleavage purposes.

Glycoprotein (gp): A protein that contains oligosaccharide chains (glycans) covalently attached to polypeptide side-chains. The carbohydrate is attached to the protein in a cotranslational or posttranslational modification. This process is known as glycosylation. In proteins that have segments extending extracellularly, the extracellular segments are often glycosylated. Glycoproteins are often important integral membrane proteins, where they play a role in cell-cell interactions. In some examples a glycoprotein is an RSV glycoprotein, such as a RSV F protein antigen stabilized in a prefusion conformation or an immunogenic fragment thereof.

Glycosylation site: An amino acid sequence on the surface of a polypeptide, such as a protein, which accommodates the attachment of a glycan. An N-linked glycosylation site is triplet sequence of NX(S/T) in which N is asparagine, X is any residues except proline, and (S/T) is a serine or threonine residue. A glycan is a polysaccharide or oligosaccharide. Glycan may also be used to refer to the carbohydrate portion of a glycoconjugate, such as a glycoprotein, glycolipid, or a proteoglycan.

Homologous proteins: Proteins that have a similar structure and function, for example, proteins from two or more species or viral strains that have similar structure and function in the two or more species or viral strains. For example a RSV F protein from RSV A is a homologous protein to a RSV F protein from bovine RSV. Homologous proteins share similar protein folding characteristics and can be considered structural homologs.

Homologous proteins typically share a high degree of sequence conservation, such as at least 80%, at least 90%, at least 91%, at least 92%, at least 93%, at least 94%, or at least 95%, at least 96%, at least 97%, at least 98%, or at least 99% sequence conservation, and a high degree of sequence identity, such as at least 80%, at least 90%, at least 91%, at least 92%, at least 93%, at least 94%, or at least 95%, at least 96%, at least 97%, at least 98%, or at least 99% sequence identity.

Host cells: Cells in which a vector can be propagated and its DNA expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Immunogen: A protein or a portion thereof that is capable of inducing an immune response in a mammal, such as a mammal infected or at risk of infection with a pathogen. Administration of an immunogen can lead to protective immunity and/or proactive immunity against a pathogen of interest. In some examples, an immunogen includes a disclosed PreF antigen.

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies.

A "Th1" biased immune response is characterized by the presence of $CD4^+$ T helper cells that produce IL-2 and IFN-γ, and thus, by the secretion or presence of IL-2 and IFN-γ. In contrast, a "Th2" biased immune response is characterized by a preponderance of CD4+ helper cells that produce IL-4, IL-5, and IL-13.

Immunogenic composition: A composition comprising an antigen that induces an immune response, such as a measurable CTL response against virus expressing the antigen, or a measurable B cell response (such as production of antibodies) against the antigen. As such, an immunogenic composition includes one or more antigens (for example, polypeptide antigens) or antigenic epitopes. An immunogenic composition can also include one or more additional components capable of eliciting or enhancing an immune response, such as an excipient, carrier, and/or adjuvant. In certain instances, immunogenic compositions are administered to elicit an immune response that protects the subject against symptoms or conditions induced by a pathogen. In some cases, symptoms or disease caused by a pathogen is prevented (or reduced or ameliorated) by inhibiting replication of the pathogen (e.g., RSV) following exposure of the subject to the pathogen. In one example, an "immunogenic composition" includes a recombinant RSV F protein stabilized in a prefusion conformation, that induces a measurable CTL response against virus expressing RSV F protein, or induces a measurable B cell response (such as production of antibodies) against RSV F protein. It further refers to isolated nucleic acids encoding an antigen, such as a nucleic acid that can be used to express the antigen (and thus be used to elicit an immune response against this polypeptide).

For in vitro use, an immunogenic composition may include an antigen or nucleic acid encoding an antigen. For in vivo use, the immunogenic composition will typically include the protein, immunogenic peptide or nucleic acid in pharmaceutically acceptable carriers, and/or other agents. Any particular peptide, such as a disclosed RSV F protein stabilized in a prefusion conformation or a nucleic acid encoding a disclosed RSV F protein stabilized in a prefusion conformation, can be readily tested for its ability to induce a CTL or B cell response by art-recognized assays. Immunogenic compositions can include adjuvants, which are well known to one of skill in the art.

Immunologically reactive conditions: Includes reference to conditions which allow an antibody raised against a particular epitope to bind to that epitope to a detectably greater degree than, and/or to the substantial exclusion of, binding to substantially all other epitopes Immunologically reactive conditions are dependent upon the format of the antibody binding reaction and typically are those utilized in immunoassay protocols or those conditions encountered in vivo. The immunologically reactive conditions employed in the methods are "physiological conditions" which include reference to conditions (such as temperature, osmolarity, pH) that are typical inside a living mammal or a mammalian cell. While it is recognized that some organs are subject to extreme conditions, the intra-organismal and intracellular environment is normally about pH 7 (such as from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

Immunological probe: A molecule that can be used for selection of antibodies from sera which are directed against a specific epitope or antigen, including from human patient sera. In some examples, the disclosed RSV F proteins stabilized in a prefusion conformation can be used as immunological probes in both positive and negative selection of antibodies specific for RSV F protein in a prefusion conformation.

Immunogenic surface: A surface of a molecule, for example RSV F protein, capable of eliciting an immune response. An immunogenic surface includes the defining features of that surface, for example the three-dimensional shape and the surface charge. In some examples, an immunogenic surface is defined by the amino acids on the surface of a protein or peptide that are in contact with an antibody, such as a neutralizing antibody, when the protein and the antibody are bound together. A target epitope includes an immunogenic surface Immunogenic surface is synonymous with antigenic surface.

Inhibiting or treating a disease: Inhibiting the full development of a disease or condition, for example, in a subject who is at risk for a disease, such as RSV infection. "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

The term "reduces" is a relative term, such that an agent reduces a response or condition if the response or condition is quantitatively diminished following administration of the agent, or if it is diminished following administration of the agent, as compared to a reference agent. Similarly, the term "prevents" does not necessarily mean that an agent completely eliminates the response or condition, so long as at least one characteristic of the response or condition is eliminated. Thus, an immunogenic composition that reduces or prevents an infection or a response, such as a pathological response, e.g., vaccine enhanced viral disease, can, but does not necessarily completely eliminate such an infection or response, so long as the infection or response is measurably diminished, for example, by at least about 50%, such as by at least about 70%, or about 80%, or even by about 90% of (that is to 10% or less than) the infection or response in the absence of the agent, or in comparison to a reference agent.

Isolated: An "isolated" biological component (such as a protein, for example a disclosed PreF antigen or nucleic acid encoding such an antigen) has been substantially separated or purified away from other biological components, such as other biological components in which the component naturally occurs, such as other chromosomal and extrachromosomal DNA, RNA, and proteins. Proteins, peptides and nucleic acids that have been "isolated" include proteins purified by standard purification methods. The term also embraces proteins or peptides prepared by recombinant expression in a host cell as well as chemically synthesized proteins, peptides and nucleic acid molecules. Isolated does not require absolute purity, and can include protein, peptide, or nucleic acid molecules that are at least 50% isolated, such as at least 75%, 80%, 90%, 95%, 98%, 99%, or even 99.9% isolated. The PreF antigens disclosed herein (for example, an isolated recombinant RSV F protein stabilized in a prefusion conformation) are isolated from RSV F proteins in a post-fusion conformation, for example, are at least 80% isolated, at least 90%, 95%, 98%, 99%, or even 99.9% isolated from RSV F proteins in a postfusion conformation.

In several embodiments, the PreF antigen is substantially separated from RSV F proteins that do not include antigen site Ø and/or are not specifically bound by a prefusion specific monoclonal antibody (such as D25 or AM22), for example, the PreF antigen may be at least 80% isolated, at least 90%, 95%, 98%, 99%, or even 99.9% isolated from RSV F proteins that do not include antigen site Ø and/or are not specifically bound by a prefusion specific monoclonal antibody, such as D25 or AM22.

$K_d$: The dissociation constant for a given interaction, such as a polypeptide-ligand interaction or an antibody-antigen interaction. For example, for the bimolecular interaction of an antibody (such as D25) and an antigen (such as RSV F protein), it is the concentration of the individual components of the bimolecular interaction divided by the concentration of the complex. Methods of determining the $K_d$ of an antibody:antigen interaction are familiar to the person of ordinary skill in the art.

Label: A detectable compound or composition that is conjugated directly or indirectly to another molecule to facilitate detection of that molecule. Specific, non-limiting examples of labels include fluorescent tags, enzymatic linkages, and radioactive isotopes. In some examples, a disclosed PreF antigen is labeled with a detectable label. In some examples, label is attached to a disclosed antigen or nucleic acid encoding such an antigen.

Linker: A bi-functional molecule that can be used to link two or more molecules into one contiguous molecule, for example, to link a carrier molecule to a immunogenic polypeptide. Non-limiting examples of peptide linkers include a $(G_4S)_1$, $(G_4S)_2$, or a $(G_4S)_3$ peptide linker.

The terms "conjugating," "joining," "bonding," or "linking" can refer to making two molecules into one contiguous molecule; for example, linking two other polypeptides into one contiguous polypeptide, or covalently attaching a carrier molecule or other molecule to an immunogenic polypeptide, such as an recombinant RSV F protein as disclosed herein. The linkage can be either by chemical or recombinant means. "Chemical means" refers to a reaction, for example, between the immunogenic polypeptide moiety and the carrier molecule such that there is a covalent bond formed between the two molecules to form one molecule.

MPE8: A neutralizing monoclonal antibody that specifically binds to the prefusion conformation of the RSV F protein, but not to the post fusion conformation of RSV F protein. As described in Corti et al. (Nature, 501(7467)439-443, 2013, incorporated by reference herein in its entirety) the MPE8 antibody binds to an epitope found on the pre-, but not post-, fusion conformations of the RSV F protein. The MPE8 epitope is not part of antigenic site Ø. The heavy and light chain variable region sequences are set forth as SEQ ID NOs: 1472 and 1473, respectively.

Native antigen or native sequence: An antigen or sequence that has not been modified by selective mutation, for example, selective mutation to focus the antigenicity of the antigen to a target epitope. Native antigen or native sequence are also referred to as wild-type antigen or wild-type sequence.

Nucleic acid: A polymer composed of nucleotide units (ribonucleotides, deoxyribonucleotides, related naturally occurring structural variants, and synthetic non-naturally occurring analogs thereof) linked via phosphodiester bonds, related naturally occurring structural variants, and synthetic non-naturally occurring analogs thereof. Thus, the term includes nucleotide polymers in which the nucleotides and the linkages between them include non-naturally occurring synthetic analogs, such as, for example and without limitation, phosphorothioates, phosphoramidates, methyl phosphonates, chiral-methyl phosphonates, 2-O-methyl ribonucleotides, peptide-nucleic acids (PNAs), and the like. Such polynucleotides can be synthesized, for example, using an automated DNA synthesizer. The term "oligonucleotide" typically refers to short polynucleotides, generally no greater than about 50 nucleotides. It will be understood that when a nucleotide sequence is represented by a DNA sequence (i.e., A, T, G, C), this also includes an RNA sequence (i.e., A, U, G, C) in which "U" replaces "T."

"Nucleotide" includes, but is not limited to, a monomer that includes a base linked to a sugar, such as a pyrimidine, purine or synthetic analogs thereof, or a base linked to an amino acid, as in a peptide nucleic acid (PNA). A nucleotide is one monomer in a polynucleotide. A nucleotide sequence refers to the sequence of bases in a polynucleotide.

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

"cDNA" refers to a DNA that is complementary or identical to an mRNA, in either single stranded or double stranded form.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (for example, rRNA, tRNA and mRNA) or a defined sequence of amino acids and the biological properties resulting therefrom. Thus, a gene encodes a protein if transcription and translation of mRNA produced by that gene produces the protein in a cell or other biological system. Both the coding strand, the nucleotide sequence of which is identical to the mRNA sequence and is usually provided in sequence listings, and non-coding strand, used as the template for transcription, of a gene or cDNA can be referred to as encoding the protein or other product of that gene or cDNA. Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns. In some examples, a nucleic acid encodes a disclosed PreF antigen.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame.

Prefusion-specific antibody: An antibody that specifically binds to the RSV F protein in a prefusion conformation, but does not specifically binds to the RSV F protein in a post-fusion conformation. Exemplary prefusion specific antibodies include the D25, AM22, 5C4 and MPE8 antibodies Polypeptide: Any chain of amino acids, regardless of length or post-translational modification (such as glycosylation or phosphorylation). "Polypeptide" applies to amino acid polymers including naturally occurring amino acid polymers and non-naturally occurring amino acid polymer as well as in which one or more amino acid residue is a non-natural amino acid, for example an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used interchangeably herein to refer to a polymer of amino acid residues.

A single contiguous polypeptide chain of amino acid residues can include multiple polypeptides. For example, the RSV $F_0$ polypeptide includes a N-terminal signal peptide, a $F_2$ polypeptide, a pep27 polypeptide, and a $F_1$ polypeptide including the $F_1$ extracellular domain, transmembrane domain and cytosolic tail. Further, in some embodiments a recombinant RSV F protein is a single chain RSV F protein including a RSV $F_2$ polypeptide linked to a RSV $F_1$ polypeptide by a peptide linker.

In many instances, a polypeptide folds into a specific three-dimensional structure, and can include surface-exposed amino acid residues and non-surface-exposed amino acid residues. In some instances a protein can include multiple polypeptides that fold together into a functional unit. For example, the RSV F protein is composed of $F_1/F_2$ heterodimers that trimerize in to a multimeric protein. "Surface-exposed amino acid residues" are those amino acids that have some degree of exposure on the surface of the protein, for example such that they can contact the solvent when the protein is in solution. In contrast, non-surface-exposed amino acids are those amino acid residues that are not exposed on the surface of the protein, such that they do not contact solution when the protein is in solution. In some examples, the non-surface-exposed amino acid residues are part of the protein core.

A "protein core" is the interior of a folded protein, which is substantially free of solvent exposure, such as solvent in the form of water molecules in solution. Typically, the protein core is predominately composed of hydrophobic or apolar amino acids. In some examples, a protein core may contain charged amino acids, for example aspartic acid, glutamic acid, arginine, and/or lysine. The inclusion of uncompensated charged amino acids (a compensated charged amino can be in the form of a salt bridge) in the protein core can lead to a destabilized protein. That is, a protein with a lower $T_m$ then a similar protein without an uncompensated charged amino acid in the protein core. In other examples, a protein core may have a cavity within the protein core. Cavities are essentially voids within a folded protein where amino acids or amino acid side chains are not present. Such cavities can also destabilize a protein relative to a similar protein without a cavity. Thus, when creating a stabilized form of a protein, it may be advantageous to substitute amino acid residues within the core in order to fill cavities present in the wild-type protein.

Amino acids in a peptide, polypeptide or protein generally are chemically bound together via amide linkages (CONH). Additionally, amino acids may be bound together by other chemical bonds. For example, linkages for amino acids or amino acid analogs can include $CH_2NH$—, —$CH_2S$—, —$CH_2$—$CH_2$—, —CH=CH— (cis and trans), —$COCH_2$—, —$CH(OH)CH_2$—, and —$CHH_2SO$— (These and others can be found in Spatola, in Chemistry and Biochemistry of Amino Acids, Peptides, and Proteins, B. Weinstein, eds., Marcel Dekker, New York, p. 267 (1983); Spatola, A. F., Vega Data (March 1983), Vol. 1, Issue 3, Peptide Backbone Modifications (general review); Morley, Trends Pharm Sci pp. 463-468, 1980; Hudson, et al., *Int J Pept Prot Res* 14:177-185, 1979; Spatola et al. *Life Sci* 38:1243-1249, 1986; Harm *J. Chem. Soc Perkin Trans.* 1307-314, 1982; Almquist et al. *J. Med. Chem.* 23:1392-1398, 1980; Jennings-White et al. *Tetrahedron Lett* 23:2533, 1982; Holladay et al. *Tetrahedron. Lett* 24:4401-4404, 1983; and Hruby Life Sci 31:189-199, 1982.

Peptide modifications: Peptides, such as the disclosed RSV F proteins stabilized in a prefusion conformation can be modified, for example to include an amino acid substitution compared to a Native RSV protein sequence, or by a variety of chemical techniques to produce derivatives having essentially the same activity and conformation as the unmodified peptides, and optionally having other desirable properties. For example, carboxylic acid groups of the protein, whether carboxyl-terminal or side chain, may be provided in the form of a salt of a pharmaceutically-acceptable cation or esterified to form a $C_1$-$C_{16}$ ester, or converted to an amide of formula $NR_1R_2$ wherein $R_1$ and $R_2$ are each independently H or $C_1$-$C_{16}$ alkyl, or combined to form a heterocyclic ring, such as a 5- or 6-membered ring Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be modified to C1-C16 alkyl or dialkyl amino or further converted to an amide.

Hydroxyl groups of the peptide side chains can be converted to $C_1$-$C_{16}$ alkoxy or to a $C_1$-$C_{16}$ ester using well-recognized techniques. Phenyl and phenolic rings of the peptide side chains can be substituted with one or more halogen atoms, such as F, Cl, Br or I, or with $C_1$-$C_{16}$ alkyl, $C_1$-$C_{16}$ alkoxy, carboxylic acids and esters thereof, or amides of such carboxylic acids. Methylene groups of the peptide side chains can be extended to homologous $C_2$-$C_4$ alkylenes. Thiols can be protected with any one of a number of well-recognized protecting groups, such as acetamide groups.

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate. In particular embodiments, suitable for administration to a subject the carrier may be sterile, and/or suspended or otherwise contained in a unit dosage form containing one or more measured doses of the composition suitable to induce the desired anti-RSV immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Prime-boost vaccination: An immunotherapy including administration of a first immunogenic composition (the primer vaccine) followed by administration of a second immunogenic composition (the booster vaccine) to a subject to induce an immune response. The primer vaccine and/or the booster vaccine include a vector (such as a viral vector, RNA, or DNA vector) expressing the antigen to which the immune response is directed. The booster vaccine is administered to the subject after the primer vaccine; the skilled artisan will understand a suitable time interval between administration of the primer vaccine and the booster vaccine, and examples of such timeframes are disclosed herein. In some embodiments, the primer vaccine, the booster vaccine, or both primer vaccine and the booster vaccine additionally include an adjuvant. In one non-limiting example, the primer vaccine is a DNA-based vaccine (or other vaccine based on gene delivery), and the booster vaccine is a protein subunit or protein nanoparticle based vaccine.

Protein nanoparticle: A multi-subunit, protein-based polyhedron shaped structure. The subunits are each composed of proteins or polypeptides (for example a glycosylated polypeptide), and, optionally of single or multiple features of the following: nucleic acids, prosthetic groups, organic and inorganic compounds. Non-limiting examples of protein nanoparticles include ferritin nanoparticles (see, e.g., Zhang, Y Int. J. Mol. Sci., 12:5406-5421, 2011, incorporated by reference herein), encapsulin nanoparticles (see, e.g., Sutter et al., Nature Struct. and Mol. Biol., 15:939-947, 2008, incorporated by reference herein), Sulfur Oxygenase Reductase (SOR) nanoparticles (see, e.g., Urich et al., Science, 311:996-1000, 2006, incorporated by reference herein), lumazine synthase nanoparticles (see, e.g., Zhang et al., J. Mol. Biol., 306: 1099-1114, 2001) or pyruvate dehydrogenase nanoparticles (see, e.g., Izard et al., PNAS 96: 1240-1245, 1999, incorporated by reference herein). Ferritin, encapsulin, SOR, lumazine synthase, and pyruvate dehydrogenase are monomeric proteins that self-assemble into a globular protein complexes that in some cases consists of 24, 60, 24, 60, and 60 protein subunits, respectively. In some examples, ferritin, encapsulin, SOR, lumazine synthase, or pyruvate dehydrogenase monomers are linked to a disclosed antigen (for example, a recombinant RSV F protein stabilized in a prefusion conformation) and self-assembled into a protein nanoparticle presenting the disclosed antigens on its surface, which can be administered to a subject to stimulate an immune response to the antigen.

Recombinant: A recombinant nucleic acid is one that has a sequence that is not naturally occurring or has a sequence that is made by an artificial combination of two otherwise separated segments of sequence. This artificial combination can be accomplished by chemical synthesis or, more commonly, by the artificial manipulation of isolated segments of nucleic acids, for example, by genetic engineering techniques. A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell. The nucleic acid can be introduced, for example, on an expression vector having signals capable of expressing the protein encoded by the introduced nucleic acid or the nucleic acid can be integrated into the host cell chromosome.

Repacking amino acid substitution: An amino acid substitution that increases the interactions of neighboring residues in a protein, for example, by enhancing hydrophobic interactions or hydrogen-bond formation, or by reducing unfavorable or repulsive interactions of neighboring residues, for example, by eliminating clusters of similarly charged residues. In several embodiments, a repacking amino acid substitution is introduced to increase the interactions of neighboring residues in the RSV F protein prefusion conformation, that are not in close proximity in the RSV F postfusion conformation. Typically, introduction of a repacking amino acid substitution will increase the $T_m$ of the prefusion conformation of the RSV F protein, and lower the $T_m$ of the postfusion conformation of the RSV F protein.

Respiratory Syncytial Virus (RSV): An enveloped non-segmented negative-sense single-stranded RNA virus of the family Paramyxoviridae. It is the most common cause of bronchiolitis and pneumonia among children in their first year of life and infects nearly all children by 3 years of age. RSV also causes repeated infections including severe lower respiratory tract disease, which may occur at any age, especially among the elderly or those with compromised cardiac, pulmonary, or immune systems. In the United States, RSV bronchiolitis is the leading cause of hospitalization in infants and a major cause of asthma and wheezing throughout childhood (Shay et al., JAMA, 282, 1440 (1999); Hall et al., N. Engl. J. Med., 360, 588 (2009)). Globally, RSV is responsible for 66,000-199,000 deaths each year for children younger than five years of age (Nair et al., Lancet, 375, 1545 (2010)), and accounts for 6.7% of deaths among infants one month to one year old—more than any other single pathogen except malaria (Lozano et al., Lancet, 380, 2095 (2013)).

The RSV genome is ~15,000 nucleotides in length and includes 10 genes encoding 11 proteins, including the glycoproteins SH, G and F. The F protein mediates fusion, allowing entry of the virus into the cell cytoplasm and also promoting the formation of syncytia. Two subtypes of human RSV strains have been described, the A and B subtypes, based on differences in the antigenicity of the G glycoprotein. RSV strains for other species are also known, including bovine RSV. Exemplary RSV strain sequences are known to the person of ordinary skill in the art. Further, several models of human RSV infection are available, including model organisms infected with hRSV, as well as model organisms infected with species specific RSV, such as use of bRSV infection in cattle (see, e.g., Bern et al., Am J, Physiol. Lung Cell Mol. Physiol., 301: L148-L156, 2011).

Several methods of diagnosing RSV infection are known, including use of Direct Fluorescent Antibody detection (DFA), Chromatographic rapid antigen detection, and detection of viral RNA using RT PCR. Quantification of viral load can be determined, for example, by Plaque Assay, antigen capture enzyme immunoassay (EIA), or PCR. Quantification of antibody levels can be performed by subtype-specific Neutralization assay or ELISA. Current RSV treatment is passive administration of the monoclonal antibody palivizumab (SYNAGIS®), which recognizes the RSV F protein (Johnson et al., J. Infect. Dis., 176, 1215 (1997); Beeler and van Wyke Coelingh, *J. Virol.*, 63, 2941 (1989)) and reduces incidence of severe disease (The IMpact-RSV Study Group, *Pediatrics,* 102, 531 (1998)). (Also see, e.g., Nam and Kun (Eds.). Respiratory Syncytial Virus: Prevention, Diagnosis and Treatment. Nova Biomedical Nova Science Publisher, 2011; and Cane (Ed.) Respiratory Syncytial Virus. Elsevier Science, 2007.)

There are several subtypes of RSV, including human subtype A, human subtype B, and bovine subtype. Within the subtypes of RSV, there are individual strains of each subtype. For example, SEQ ID NOs: 1-128 provided herein include RSV F protein sequences for many strains of subtype A RSV, which (as shown in Table 3 below) are highly homologous.

RSV Fusion (F) protein: An RSV envelope glycoprotein that facilitates fusion of viral and cellular membranes. In nature, the RSV F protein is initially synthesized as a single polypeptide precursor approximately 574 amino acids in length, designated $F_0$. $F_0$ includes an N-terminal signal peptide that directs localization to the endoplasmic reticulum, where the signal peptide (approximately the first 25 residues of $F_0$) is proteolytically cleaved. The remaining $F_0$ residues oligomerize to form a trimer which is again proteolytically processed by a cellular protease at two conserved furin consensus cleavage sequences (approximately $F_0$ positions 109 and 136; for example, $RARR_{109}$ (SEQ ID NO: 124, residues 106-109) and $RKRR_{136}$ (SEQ ID NO: 124, residues 133-136) to generate two disulfide-linked fragments, $F_1$ and $F_2$. The smaller of these fragments, $F_2$, originates from the N-terminal portion of the $F_0$ precursor and includes approximately residues 26-109 of $F_0$. The larger of these fragments, $F_1$, includes the C-terminal portion of the $F_0$ precursor (approximately residues 137-574) including an extracellular/lumenal region (~residues 137-524), a transmembrane domain (~residues 525-550), and a cytoplasmic domain (~residues 551-574) at the C-terminus.

Three $F_2$-$F_1$ protomers oligomerize in the mature F protein, which adopts a metastable "prefusion" conformation that is triggered to undergo a conformational change (to a "postfusion" conformation) upon contact with a target cell membrane. This conformational change exposes a hydrophobic sequence, known as the fusion peptide, which is located at the N-terminus of the $F_1$ polypeptide, and which associates with the host cell membrane and promotes fusion of the membrane of the virus, or an infected cell, with the target cell membrane.

A number of neutralizing antibodies that specifically bind to antigenic sites on RSV F protein have been identified. These include monoclonal antibodies 131-2a and 2F, which bind to antigenic site I (centered around residue P389); monoclonal antibodies palivizumab and motavizumab, which bind to antigenic site II (centered around residues 254-277); and monoclonal antibodies 101F and mAb19, which bind to antigenic site IV (centered around residues 429-437).

Single chain RSV F protein: A recombinant RSV F protein that is expressed as a single polypeptide chain including the RSV $F_1$ polypeptide and the RSV $F_2$ polypeptide. The single chain RSV F protein trimerizes to form a RSV F protein ectodomain. A single chain RSV F protein does not include the furin cleavage sites flanking the pep27 polypeptide of RSV F protein; therefore, when produced in cells, the $F_0$ polypeptide is not cleaved into separate $F_1$ and $F_2$ polypeptides. In some embodiments, a single chain RSV F protein includes deletion of the two furin cleavage sites, the pep27 polypeptide, and the fusion peptide. In one embodiment, position 103 or 105 is linked to position 145 of the RSV protein to generate the single chain construction. In several embodiments, the remaining portions of the $F_1$ and $F_2$ polypeptides are joined by a linker, such as a peptide linker.

RSV $F_0$ polypeptide ($F_0$): The precursor of the RSV F protein, including the amino acids of a N-terminal signal peptide, a $F_2$ polypeptide, a pep27 polypeptide, and a $F_1$ polypeptide including the $F_1$ extracellular domain, transmembrane domain and cytosolic tail. The native $F_0$ polypeptide is proteolytically processed at a signal sequence cleavage site, and two furin cleavage sites (approximately $F_0$ positions 109 and 136; for example, $RARR_{109}$ (SEQ ID NO: 124, residues 106-109) and $RKRR_{136}$ (SEQ ID NO: 124, residues 133-136), resulting in the $F_1$ and $F_2$ fragments. Examples of $F_0$ polypeptides from many different RSV subgroups are known, including from the A, B and bovine subgroups, examples of which are set forth herein as SEQ ID NOs: 1-128, 129-177, and 178-184, respectively.

RSV $F_1$ polypeptide ($F_1$): A peptide chain of the RSV F protein. As used herein, "$F_1$ polypeptide" refers to both native $F_1$ polypeptides and $F_1$ polypeptides including modifications (e.g., amino acid substitutions, insertions, or deletion) from the native sequence, for example, modifications designed to stabilize a recombinant F protein (including the modified $F_1$ polypeptide) in a RSV F protein prefusion conformation. Native $F_1$ includes approximately residues 137-574 of the RSV $F_0$ precursor, and includes (from N- to C-terminus) an extracellular/lumenal region (~residues 137-524), a transmembrane domain (~residues 525-550), and a cytoplasmic domain (~residues 551-574). Several embodiments include an $F_1$ polypeptide modified from a native $F_1$ sequence, for example an $F_1$ polypeptide that lacks the transmembrane and cytosolic domain, and/or includes one or more amino acid substitutions that stabilize a recombinant F protein (containing the $F_1$ polypeptide) in a prefusion conformation. In one example, a disclosed RSV F protein includes a $F_1$ polypeptide with deletion of the transmembrane and cytosolic domains, and cysteine substitutions at positions 155 and 290. In another example, a disclosed RSV F protein includes a $F_1$ polypeptide with deletion of the transmembrane and cytosolic domains, cysteine substitutions at positions 155 and 290, and a phenylalanine substitution at position 190. In another example, a disclosed RSV F protein includes a $F_1$ polypeptide with deletion of the transmembrane and cytosolic domains, cysteine substitutions at positions 155 and 290, a phenylalanine substitution at position 190, and a leucine substitution at position 207. In several embodiments, the F1 polypeptide includes a C-terminal linkage to a trimerization domain. Many examples of native $F_1$ sequences are known which are provided herein as approximately positions 137-524 of SEQ ID NOs: 1-184.

RSV $F_2$ polypeptide ($F_2$): A polypeptide chain of the RSV F protein. As used herein, "$F_2$ polypeptide" refers to both native $F_2$ polypeptides and $F_2$ polypeptides including modifications (e.g., amino acid substitutions) from the native sequence, for example, modifications designed to stabilize a recombinant F protein (including the modified $F_2$ polypeptide) in a RSV F protein prefusion conformation. Native $F_2$ includes approximately residues 26-109 of the RSV $F_0$ precursor. In native RSV F protein, the $F_2$ polypeptide is linked to the $F_1$ polypeptide by two disulfide bonds. Many examples of native $F_2$ sequences are known which are provided herein as approximately positions 26-109 of SEQ ID NOs: 1-184.

RSV pep27 polypeptide (pep27): A 27 amino acid polypeptide that is excised from the $F_0$ precursor during maturation of the RSV F protein. pep27 is flanked by two furin cleavage sites that are cleaved by a cellular protease during F protein maturation to generate the $F_1$ and $F_2$ polypeptide. Examples of native pep27 sequences are known which are provided herein as positions 110-136 of SEQ ID NOs: 1-184.

RSV F protein prefusion conformation: A structural conformation adopted by the RSV F protein prior to triggering of the fusogenic event that leads to transition of RSV F to the postfusion conformation and following processing into a mature RSV F protein in the secretory system. The three-dimensional structure of an exemplary RSV F protein in a prefusion conformation is disclosed herein (see Example 1) and the structural coordinates of the exemplary RSV F protein in a prefusion conformation bound by the prefusion-specific antibody D25 are provided in Table 1. As shown herein, the prefusion conformation of RSV F is similar in overall structure to the prefusion conformation of other paramyxoviruses (such as PIV, see FIG. 7), though with some significant differences. In the prefusion state, the RSV F protein includes an antigenic site at the membrane distal apex ("antigenic site Ø," see Example 1), that includes RSV F residues 62-69 and 196-209, and also includes the epitopes of the D25 and AM22 antibodies. As used herein, a recombinant RSV F protein stabilized in a prefusion conformation can be specifically bound by an antibody that is specific for the prefusion conformation of the RSV F protein, such as an antibody that specifically binds to an epitope within antigenic site Ø, for example, the D25 or AM22 antibody. Additional prefusion specific antibodies include the 5C4 and MPE8 antibodies.

RSV F protein postfusion conformation: A structural conformation adopted by the RSV F protein that is not the prefusion conformation, and in which the N- and C-termini of the RSV F protein are proximal in a stable coil-coil. The post fusion conformation of RSV F protein has been described at the atomic level (see, e.g., McLellan et al., *J. Virol.,* 85, 7788, 2011; Swanson et al., *Proc. Natl. Acad. Sci. U.S.A.,* 108, 9619, 2011; and structural coordinates deposited PDB Accession No. 3RRR; each of which is incorporated by reference herein). The post-fusion conformation of RSV F protein is similar to that known for other paramyxovirus glycoproteins, including the PIV5 F protein. In the postfusion conformation, the RSV F protein does not include antigenic site Ø, and therefore does not include the D25 epitope and is not specifically bound by D25 or AM22. The RSV postfusion conformation occurs, for example, following fusion of the F protein with the cell membrane. The sequence of a RSV F protein that when expressed, can fold into a post-fusion conformation, is provided as SEQ ID NO: 1469.

Resurfaced antigen or resurfaced immunogen: A polypeptide immunogen derived from a wild-type antigen in which amino acid residues outside or exterior to a target epitope are mutated in a systematic way to focus the immunogenicity of the antigen to the selected target epitope. In some examples a resurfaced antigen is referred to as an antigenically-cloaked immunogen or antigenically-cloaked antigen.

Root mean square deviation (RMSD): The square root of the arithmetic mean of the squares of the deviations from the mean. In several embodiments, RMSD is used as a way of expressing deviation or variation from the structural coordinates of a reference three dimensional structure. This number is typically calculated after optimal superposition of two structures, as the square root of the mean square distances between equivalent $C_\alpha$ atoms. In some embodiments, the reference three-dimensional structure includes the structural coordinates of the RSV F protein bound to monoclonal antibody D25, set forth herein in Table 1.

Sequence identity/similarity: The identity/similarity between two or more nucleic acid sequences, or two or more amino acid sequences, is expressed in terms of the identity or similarity between the sequences. Sequence identity can be measured in terms of percentage identity; the higher the percentage, the more identical the sequences are. Homologs or orthologs of nucleic acid or amino acid sequences possess a relatively high degree of sequence identity/similarity when aligned using standard methods.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, Gene, 73:237-44, 1988; Higgins & Sharp, *CABIOS* 5:151-3, 1989; Corpet et al., *Nuc. Acids Res.* 16:10881-90, 1988; Huang et al. *Computer Appls. in the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. For example, a peptide sequence that has 1166 matches when aligned with a test sequence having 1554 amino acids is 75.0 percent identical to the test sequence ($1166 \div 1554 * 100 = 75.0$). The percent sequence identity value is rounded to the nearest tenth. For example, 75.11, 75.12, 75.13, and 75.14 are rounded down to 75.1, while 75.15, 75.16, 75.17, 75.18, and 75.19 are rounded up to 75.2. The length value will always be an integer.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Homologs and variants of a polypeptide are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

For sequence comparison of nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used. Methods of alignment of sequences for comparison are well known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Nat'l. Acad. Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013). One example of a useful algorithm is PILEUP. PILEUP uses a simplification of the progressive alignment method of Feng & Doolittle, *J. Mol. Evol.* 35:351-360, 1987. The method used is similar to the method described by Higgins & Sharp, *CABIOS* 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nuc. Acids Res.* 12:387-395, 1984.

Another example of algorithms that are suitable for determining percent sequence identity and sequence similarity are the BLAST and the BLAST 2.0 algorithm, which are described in Altschul et al., *J. Mol. Biol.* 215:403-410, 1990 and Altschul et al., *Nucleic Acids Res.* 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. The BLASTP program (for amino acid sequences) uses as defaults a word length (W) of 3, and expectation (E) of 10, and the BLOSUM62 scoring matrix (see Henikoff & Henikoff, *Proc. Natl. Acad. Sci. USA* 89:10915, 1989). An oligonucleotide is a linear polynucleotide sequence of up to about 100 nucleotide bases in length.

Another indicia of sequence similarity between two nucleic acids is the ability to hybridize. The more similar are the sequences of the two nucleic acids, the more stringent the conditions at which they will hybridize. The stringency of hybridization conditions are sequence-dependent and are different under different environmental parameters. Thus, hybridization conditions resulting in particular degrees of stringency will vary depending upon the nature of the hybridization method of choice and the composition and length of the hybridizing nucleic acid sequences. Generally, the temperature of hybridization and the ionic strength (especially the $Na^+$ and/or $Mg^{++}$ concentration) of the hybridization buffer will determine the stringency of hybridization, though wash times also influence stringency. Generally, stringent conditions are selected to be about 5° C. to 20° C. lower than the thermal melting point ($T_m$) for the specific sequence at a defined ionic strength and pH. The $T_m$ is the temperature (under defined ionic strength and pH) at which 50% of the target sequence hybridizes to a perfectly matched probe. Conditions for nucleic acid hybridization and calculation of stringencies can be found, for example, in Sambrook et al., *Molecular Cloning: A Laboratory Manual*, Cold Spring Harbor Laboratory Press, Cold Spring Harbor, N.Y., 2001; Tijssen, *Hybridization With Nucleic Acid Probes, Part I: Theory and Nucleic Acid Preparation*, Laboratory Techniques in Biochemistry and Molecular Biology, Elsevier Science Ltd., NY, NY, 1993; and Ausubel et al. *Short Protocols in Molecular Biology*, 4$^{th}$ ed., John Wiley & Sons, Inc., 1999.

As used herein, reference to "at least 80% identity" refers to "at least 80%, at least 85%, at least 90%, at least 91%, at least 92%, at least 93%, at least 94%, at least 95%, at least 96%, at least 97%, at least 98%, at least 99%, or even 100% identity" to a specified reference sequence.

Signal Peptide: A short amino acid sequence (e.g., approximately 18-25 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region). Exemplary signal peptide sequences are set forth as residues 1-25 of SEQ ID NOs: 1-182 (RSV F protein signal peptides from A, B, and bovine RSV).

Specifically bind: When referring to the formation of an antibody: antigen protein complex, refers to a binding reaction which determines the presence of a target protein, peptide, or polysaccharide (for example a glycoprotein), in the presence of a heterogeneous population of proteins and other biologics. Thus, under designated conditions, an antibody binds preferentially to a particular target protein, peptide or polysaccharide (such as an antigen present on the surface of a pathogen, for example RSV F) and does not bind in a significant amount to other proteins or polysaccharides present in the sample or subject. An antibody that specifically binds to the prefusion conformation of RSV F protein (e.g., and antibody that specifically binds to antigenic site Ø) does not specifically bind to the postfusion conformation of RSV F protein. Specific binding can be determined by methods known in the art. With reference to an antibody: antigen or Fab:antigen complex, specific binding of the antigen and antibody has a $K_d$ (or apparent $K_d$) of less than about 10' Molar, such as less than about $10^{-7}$ Molar, $10^{-8}$ Molar, $10^{-9}$, or even less than about $10^{-10}$ Molar.

Soluble protein: A protein capable of dissolving in aqueous liquid at room temperature and remaining dissolved. The solubility of a protein may change depending on the concentration of the protein in the water-based liquid, the buffering condition of the liquid, the concentration of other solutes in the liquid, for example salt and protein concentrations, and the heat of the liquid. In several embodiments, a soluble protein is one that dissolves to a concentration of at least 0.5 mg/ml in phosphate buffered saline (pH 7.4) at room temperature and remains dissolved for at least 48 hours.

Therapeutic agent: A chemical compound, small molecule, or other composition, such as nucleic acid molecule, capable of inducing a desired therapeutic or prophylactic effect when properly administered to a subject.

Therapeutically effective amount of effective amount: The amount of agent, such as a disclosed antigen or immunogenic composition containing a disclosed antigen, that is sufficient to prevent, treat (including prophylaxis), reduce and/or ameliorate the symptoms and/or underlying causes of any of a disorder or disease, for example to prevent, inhibit, and/or treat RSV infection. In some embodiments, a therapeutically effective amount is sufficient to reduce or eliminate a symptom of a disease, such as RSV infection. For instance, this can be the amount necessary to inhibit viral replication or to measurably alter outward symptoms of the viral infection. In general, this amount will be sufficient to measurably inhibit virus (for example, RSV) replication or infectivity. When administered to a subject, a dosage will generally be used that will achieve target tissue concentrations that has been shown to achieve in vitro inhibition of viral replication. It is understood that to obtain a protective immune response against a pathogen can require multiple administrations of the immunogenic composition. Thus, a therapeutically effective amount encompasses a fractional dose that contributes in combination with previous or subsequent administrations to attaining a protective immune response.

Transmembrane domain: An amino acid sequence that inserts into a lipid bilayer, such as the lipid bilayer of a cell or virus or virus-like particle. A transmembrane domain can be used to anchor an antigen to a membrane. In some examples a transmembrane domain is a RSV F protein transmembrane domain. Exemplary RSV F transmembrane domains are familiar to the person of ordinary skill in the art, and provided herein. For example, the amino acid sequences of exemplary RSV F transmembrane domains are provided as approximately positions 525-550 of SEQ ID NOs: 1-183.

Transformed: A transformed cell is a cell into which a nucleic acid molecule has been introduced by molecular biology techniques. As used herein, the term transformation encompasses all techniques by which a nucleic acid molecule might be introduced into such a cell, including transfection with viral vectors, transformation with plasmid vectors, and introduction of DNA by electroporation, lipofection, and particle gun acceleration.

Vaccine: A pharmaceutical composition that elicits a prophylactic or therapeutic immune response in a subject. In some cases, the immune response is a protective immune response. Typically, a vaccine elicits an antigen-specific immune response to an antigen of a pathogen, for example a viral pathogen, or to a cellular constituent correlated with a pathological condition. A vaccine may include a polynucleotide (such as a nucleic acid encoding a disclosed antigen), a peptide or polypeptide (such as a disclosed antigen), a virus, a cell or one or more cellular constituents.

Vector: A nucleic acid molecule as introduced into a host cell, thereby producing a transformed host cell. Recombinant DNA vectors are vectors having recombinant DNA. A vector can include nucleic acid sequences that permit it to replicate in a host cell, such as an origin of replication. A vector can also include one or more selectable marker genes and other genetic elements known in the art. Viral vectors are recombinant DNA vectors having at least some nucleic acid sequences derived from one or more viruses.

A replication deficient viral vector that requires complementation of one or more regions of the viral genome required for replication, as a result of, for example a deficiency in at least one replication-essential gene function. For example, such that the viral vector does not replicate in typical host cells, especially those in a human patient that could be infected by the viral vector in the course of a therapeutic method. Examples of replication-deficient viral vectors and systems for their use are known in the art and include; for example replication-deficient LCMV vectors (see, e.g., U.S. Pat. Pub. No. 2010/0297172, incorporated by reference herein in its entirety) and replication deficient adenoviral vectors (see, e.g., PCT App. Pub. No. WO2000/00628, incorporated by reference herein).

Virus: A virus consists essentially of a core of nucleic acid surrounded by a protein coat, and has the ability to replicate only inside a living cell. "Viral replication" is the production of additional virus by the occurrence of at least one viral life cycle. A virus may subvert the host cells' normal functions, causing the cell to behave in a manner determined by the virus. For example, a viral infection may result in a cell producing a cytokine, or responding to a cytokine, when the uninfected cell does not normally do so. In some examples, a virus is a pathogen.

Virus-like particle (VLP): A non-replicating, viral shell, derived from any of several viruses. VLPs are generally composed of one or more viral proteins, such as, but not limited to, those proteins referred to as capsid, coat, shell, surface and/or envelope proteins, or particle-forming polypeptides derived from these proteins. VLPs can form spontaneously upon recombinant expression of the protein in an appropriate expression system. Methods for producing particular VLPs are known in the art. The presence of VLPs following recombinant expression of viral proteins can be detected using conventional techniques known in the art, such as by electron microscopy, biophysical characterization, and the like. Further, VLPs can be isolated by known techniques, e.g., density gradient centrifugation and identified by characteristic density banding. See, for example, Baker et al. (1991) *Biophys. J.* 60:1445-1456; and Hagensee et al. (1994) *J. Virol.* 68:4503-4505; Vincente, *J Invertebr Pathol.*, 2011; Schneider-Ohrum and Ross, *Curr. Top. Microbiol. Immunol.*, 354: 53073, 2012).

II. DESCRIPTION OF SEVERAL EMBODIMENTS

Figure 2B:
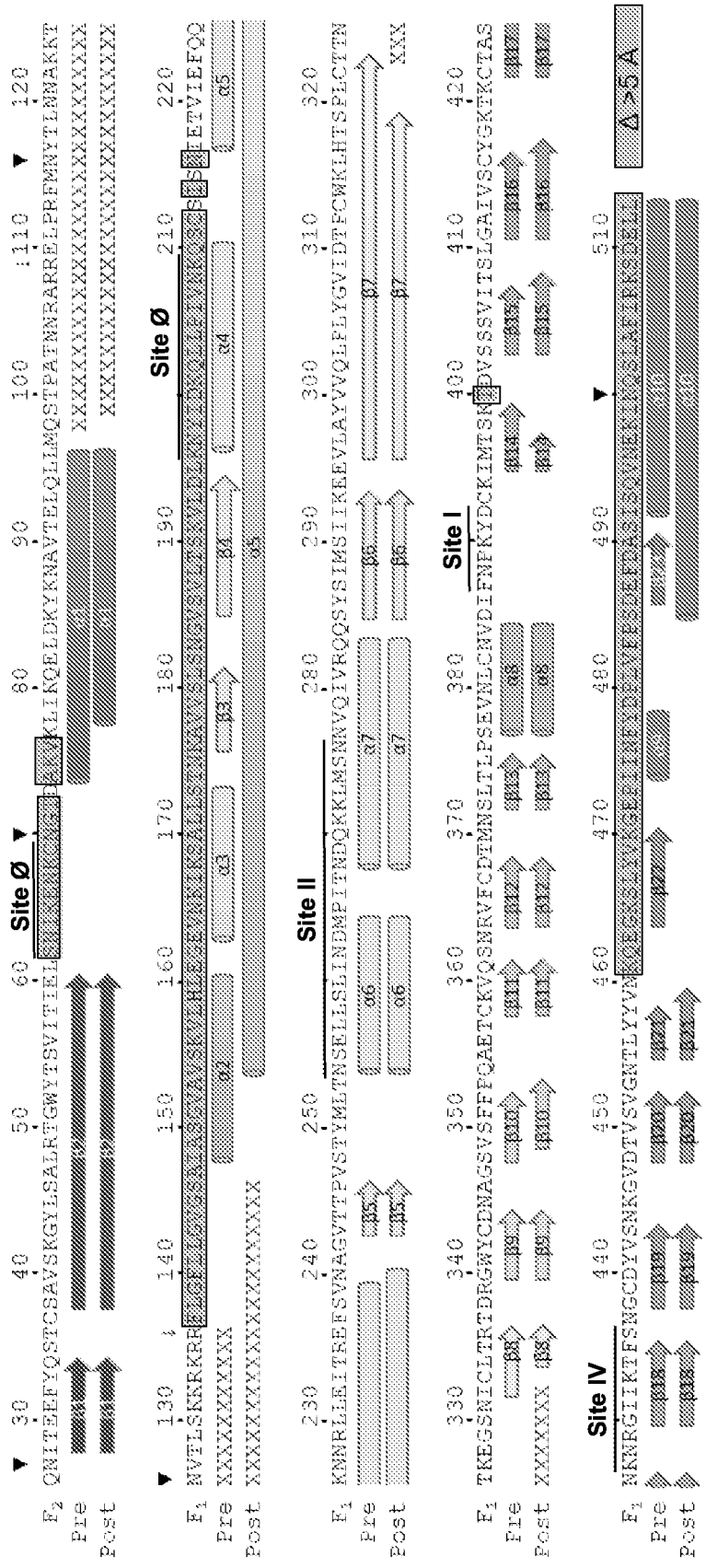

It is disclosed herein that the RSV F protein undergoes a dramatic structural rearrangement between its pre- and post-fusion conformations (see Example 1, below). As shown in FIG. 2B, the N-terminal region of the $F_1$ polypeptide in the prefusion conformation (corresponding in part to the membrane distal lobe shown in FIG. 2A) includes the indicated $\alpha2$, $\alpha3$, $\beta3$, $\beta4$, and $\alpha4$ helical and beta sheet structures, whereas the corresponding region of the N-terminus of the $F_1$ polypeptide in the postfusion structure includes an extended $\alpha5$ helical structure. Further, the C-terminal region of the $F_1$ polypeptide in the prefusion conformation (corresponding in part to the membrane proximal lobe shown in FIG. 2A) includes the indicated $\beta22$, $\alpha9$, and $\beta23$ beta sheet and helical structures, whereas the corresponding C-terminal region of the of the $F_1$ polypeptide in the postfusion conformation structure includes an extended $\alpha10$ helical structure. Thus, the membrane distal and membrane proximal lobes of the RSV F protein in its prefusion conformation include several distinct structural elements that are absent from the corresponding regions of the RSV F protein in its postfusion conformation. Amino acid positions (and sequences) corresponding to these regions are highlighted in grey in FIG. 2, including positions 137-216, and 461-513 of the $F_1$ polypeptide.

RSV F protein antigens are provided that are stabilized or "locked" in a prefusion conformation, termed "PreF antigens." Using structure-guided design, positions of the RSV $F_1$ and $F_2$ polypeptides are targeted for modification (e.g., amino acid substitution) to hinder or prevent transition of the RSV F protein from a pre- to postfusion conformation. Such antigens have utility, for example, as immunogens to induce a neutralizing response to RSV F protein.

A. Native RSV F Proteins

Native RSV F proteins from different RSV groups, as well as nucleic acid sequences encoding such proteins and methods, are known. For example, the sequence of several subtype A, B and bovine precursor RSV $F_0$ proteins provided as SEQ ID NOs: 1-184. The GenInfo Identifier (gi) and corresponding accession number for each of these sequences, as well as the corresponding RSV group are provided in Table 3:

TABLE 3

Exemplary Subtype A, B and bovine RSV F protein sequences

| SEQ ID | Subtype | Accession |
|---|---|---|
| 1 | A | >gi\|113472470\|gb\|AB135685.1 |
| 2 | A | >gi\|46405966\|gb\|AAS93651.1 |
| 3 | A | >gi\|346682949\|gb\|AEO45830.1 |
| 4 | A | >gi\|392301680\|gb\|AFM55244.1 |
| 5 | A | >gi\|392301896\|gb\|AFM55442.1 |
| 6 | A | >gi\|392301692\|gb\|AFM55255.1 |
| 7 | A | >gi\|392301728\|gb\|AFM55288.1 |
| 8 | A | >gi\|392976459\|gb\|AFM95385.1 |
| 9 | A | >gi\|392976475\|gb\|AFM95400.1 |
| 10 | A | >gi\|21689583\|gb\|AAM68157.1 |
| 11 | A | >gi\|21689587\|gb\|AAM68160.1 |
| 12 | A | >gi\|346682981\|gb\|AEO45859.1 |
| 13 | A | >gi\|352962949\|gb\|AEQ63444.1 |
| 14 | A | >gi\|353441614\|gb\|AEQ98752.1 |
| 15 | A | >gi\|392301740\|gb\|AFM55299.1 |
| 16 | A | >gi\|346682971\|gb\|AEO45850.1 |
| 17 | A | >gi\|346682992\|gb\|AEO45869.1 |
| 18 | A | >gi\|346683003\|gb\|AEO45879.1 |
| 19 | A | >gi\|346683036\|gb\|AEO45909.1 |
| 20 | A | >gi\|21689579\|gb\|AAM68154.1 |
| 21 | A | >gi\|326578296\|gb\|ADZ95777.1 |
| 22 | A | >gi\|330470871\|gb\|AEC32087.1 |
| 23 | A | >gi\|346683058\|gb\|AEO45929.1 |
| 24 | A | >gi\|392301644\|gb\|AFM55211.1 |
| 25 | A | >gi\|392301656\|gb\|AFM55222.1 |
| 26 | A | >gi\|392301776\|gb\|AFM55332.1 |
| 27 | A | >gi\|46405962\|gb\|AAS93649.1 |
| 28 | A | >gi\|326578298\|gb\|ADZ95778.1 |
| 29 | A | >gi\|392301872\|gb\|AFM55420.1 |
| 30 | A | >gi\|346682960\|gb\|AEO45840.1 |
| 31 | A | >gi\|346683080\|gb\|AEO45949.1 |
| 32 | A | >gi\|227299\|prf\|1701388A/1-574 |
| 33 | A | >gi\|352962996\|gb\|AEQ63487.1 |
| 34 | A | >gi\|352963032\|gb\|AEQ63520.1 |
| 35 | A | >gi\|46405970\|gb\|AAS93653.1 |
| 36 | A | >gi\|392976437\|gb\|AFM95365.1 |
| 37 | A | >gi\|392976449\|gb\|AFM95376.1 |
| 38 | A | >gi\|352962805\|gb\|AEQ63312.1 |
| 39 | A | >gi\|346340362\|gb\|AEO23051.1 |
| 40 | A | >gi\|352962829\|gb\|AEQ63334.1 |
| 41 | A | >gi\|352962865\|gb\|AEQ63367.1 |
| 42 | A | >gi\|392302028\|gb\|AFM55563.1 |
| 43 | A | >gi\|392302016\|gb\|AFM55552.1 |
| 44 | A | >gi\|417346971\|gb\|AFX60137.1 |
| 45 | A | >gi\|417347051\|gb\|AFX60173.1 |
| 46 | A | >gi\|392301812\|gb\|AFM55365.1 |
| 47 | A | >gi\|29290039\|gb\|AAO72323.1 |
| 48 | A | >gi\|29290041\|gb\|AAO72324.1 |
| 49 | A | >gi\|262479010\|gb\|ACY68435.1 |
| 50 | A | >gi\|330470867\|gb\|AEC32085.1 |
| 51 | A | >gi\|392301704\|gb\|AFM55266.1 |
| 52 | A | >gi\|392301716\|gb\|AFM55277.1 |
| 53 | A | >gi\|392301800\|gb\|AFM55354.1 |
| 54 | A | >gi\|345548062\|gb\|AEO12131.1 |
| 55 | A | >gi\|346340367\|gb\|AEO23052.1 |
| 56 | A | >gi\|352962889\|gb\|AEQ63389.1 |
| 57 | A | >gi\|353441606\|gb\|AEQ98748.1 |
| 58 | A | >gi\|353441604\|gb\|AEQ98747.1 |
| 59 | A | >gi\|353441608\|gb\|AEQ98749.1 |
| 60 | A | >gi\|353441616\|gb\|AEQ98753.1 |
| 61 | A | >gi\|353441620\|gb\|AEQ98755.1 |
| 62 | A | >gi\|353441624\|gb\|AEQ98757.1 |
| 63 | A | >gi\|409905594\|gb\|AFV46409.1 |
| 64 | A | >gi\|409905610\|gb\|AFV46417.1 |
| 65 | A | >gi\|417346953\|gb\|AFX60128.1 |
| 66 | A | >gi\|417347079\|gb\|AFX60187.1 |
| 67 | A | >gi\|417346955\|gb\|AFX60129.1 |
| 68 | A | >gi\|417346967\|gb\|AFX60135.1 |
| 69 | A | >gi\|417346979\|gb\|AFX60141.1 |
| 70 | A | >gi\|417346993\|gb\|AFX60148.1 |
| 71 | A | >gi\|417346999\|gb\|AFX60151.1 |
| 72 | A | >gi\|417347043\|gb\|AFX60169.1 |
| 73 | A | >gi\|417347105\|gb\|AFX60200.1 |
| 74 | A | >gi\|417347107\|gb\|AFX60201.1 |
| 75 | A | >gi\|392301788\|gb\|AFM55343.1 |
| 76 | A | >gi\|409905578\|gb\|AFV46401.1 |
| 77 | A | >gi\|409905596\|gb\|AFV46410.1 |
| 78 | A | >gi\|353441622\|gb\|AEQ98756.1 |
| 79 | A | >gi\|409905582\|gb\|AFV46403.1 |
| 80 | A | >gi\|417347109\|gb\|AFX60202.1 |
| 81 | A | >gi\|409905602\|gb\|AFV46413.1 |
| 82 | A | >gi\|409905604\|gb\|AFV46414.1 |
| 83 | A | >gi\|417347121\|gb\|AFX60208.1 |
| 84 | A | >gi\|409905614\|gb\|AFV46419.1 |
| 85 | A | >gi\|409905616\|gb\|AFV46420.1 |
| 86 | A | >gi\|417346973\|gb\|AFX60138.1 |
| 87 | A | >gi\|417346997\|gb\|AFX60150.1 |
| 88 | A | >gi\|417347021\|gb\|AFX60162.1 |
| 89 | A | >gi\|417347085\|gb\|AFX60190.1 |
| 90 | A | >gi\|425706126\|gb\|AFX95851.1 |
| 91 | A | >gi\|392301836\|gb\|AFM55387.1 |
| 92 | A | >gi\|392301992\|gb\|AFM55530.1 |
| 93 | A | >gi\|346683047\|gb\|AEO45919.1 |
| 94 | A | >gi\|46405974\|gb\|AAS93655.1 |
| 95 | A | >gi\|46405976\|gb\|AAS93656.1 |
| 96 | A | >gi\|346683069\|gb\|AEO45939.1 |
| 97 | A | >gi\|13532011\|sp\|P11209.2 |
| 98 | A | >gi\|1912295\|gb\|AAC57027.1 |
| 99 | A | >gi\|9629375\|ref\|NP_044596.1 |
| 100 | A | >gi\|21263086\|gb\|AAM44851.1 |
| 101 | A | >gi\|417346951\|gb\|AFX60127.1 |
| 102 | A | >gi\|417347009\|gb\|AFX60156.1 |
| 103 | A | >gi\|29290043\|gb\|AAO72325.1 |
| 104 | A | >gi\|138252\|sp\|P12568.1 |
| 105 | A | >gi\|226438\|prf\|\|1512372A |
| 106 | A | >gi\|37674744\|gb\|AAQ97026.1 |
| 107 | A | >gi\|37674754\|gb\|AAQ97031.1 |
| 108 | A | >gi\|37674746\|gb\|AAQ97027.1 |
| 109 | A | >gi\|37674748\|gb\|AAQ97028.1 |
| 110 | A | >gi\|37674750\|gb\|AAQ97029.1 |
| 111 | A | >gi\|37674752\|gb\|AAQ97030.1 |
| 112 | A | >gi\|146738079\|gb\|ABQ42594.1 |
| 113 | A | >gi\|403379\|emb\|CAA81295.1 |
| 114 | A | >gi\|226838116\|gb\|ACO83302.1 |
| 115 | A | >gi\|326578304\|gb\|ADZ95781.1 |
| 116 | A | >gi\|326578306\|gb\|ADZ95782.1 |
| 117 | A | >gi\|326578308\|gb\|ADZ95783.1 |
| 118 | A | >gi\|326578310\|gb\|ADZ95784.1 |
| 119 | A | >gi\|326578312\|gb\|ADZ95785.1 |
| 120 | A | >gi\|60549171\|gb\|AAX23994.1 |
| 121 | A | >gi\|226838109\|gb\|ACO83297.1 |
| 122 | A | >gi\|352962877\|gb\|AEQ63378.1 |
| 123 | A | >gi\|346683014\|gb\|AEO45889.1 |
| 124 | A | >gi\|138251\|sp\|P03420.11 |
| 125 | A | >gi\|1695263\|gb\|AAC55970.1 |
| 126 | A | >gi\|61211\|emb\|CAA26143.1 |
| 127 | A | >gi\|226838114\|gb\|ACO83301.1 |

TABLE 3-continued

Exemplary Subtype A, B and bovine RSV F protein sequences

| SEQ ID | Subtype | Accession |
|---|---|---|
| 128 | A | >gi|352963080|gb|AEQ63564.1 |
| 129 | B | >gi|109689536|dbj|BAE96918.1 |
| 130 | B | >gi|380235900|gb|AFD34266.1 |
| 131 | B | >gi|401712638|gb|AFP99059.1 |
| 132 | B | >gi|401712648|gb|AFP99064.1 |
| 133 | B | >gi|380235886|gb|AFD34259.1 |
| 134 | B | >gi|326578302|gb|ADZ95780.1 |
| 135 | B | >gi|326578294|gb|ADZ95776.1 |
| 136 | B | >gi|326578300|gb|ADZ95779.1 |
| 137 | B | >gi|380235892|gb|AFD34262.1 |
| 138 | B | >gi|464405984|gb|AAS93660.1 |
| 139 | B | >gi|464405986|gb|AAS93661.1 |
| 140 | B | >gi|464405990|gb|AAS93663.1 |
| 141 | B | >gi|464405992|gb|AAS93664.1 |
| 142 | B | >gi|345121421|gb|AEN74946.1 |
| 143 | B | >gi|417347137|gb|AFX60215.1 |
| 144 | B | >gi|380235888|gb|AFD34260.1 |
| 145 | B | >gi|346340378|gb|AEO23054.1 |
| 146 | B | >gi|384872848|gb|AFI25262.1 |
| 147 | B | >gi|380235890|gb|AFD34261.1 |
| 148 | B | >gi|464405978|gb|AAS93657.1 |
| 149 | B | >gi|464405982|gb|AAS93659.1 |
| 150 | B | >gi|352963104|gb|AEQ63586.1 |
| 151 | B | >gi|352963128|gb|AEQ63608.1 |
| 152 | B | >gi|352963164|gb|AEQ63641.1 |
| 153 | B | >gi|464405996|gb|AAS93666.1 |
| 154 | B | >gi|417347131|gb|AFX60212.1 |
| 155 | B | >gi|417347135|gb|AFX60214.1 |
| 156 | B | >gi|417347145|gb|AFX60219.1 |
| 157 | B | >gi|380235898|gb|AFD34265.1 |
| 158 | B | >gi|352963116|gb|AEQ63597.1 |
| 159 | B | >gi|401712640|gb|AFP99060.1 |
| 160 | B | >gi|352963152|gb|AEQ63630.1 |
| 161 | B | >gi|401712642|gb|AFP99061.1 |
| 162 | B | >gi|417347133|gb|AFX60213.1 |
| 163 | B | >gi|417347147|gb|AFX60220.1 |
| 164 | B | >gi|417347151|gb|AFX60222.1 |
| 165 | B | >gi|417347169|gb|AFX60231.1 |
| 166 | B | >gi|417347171|gb|AFX60232.1 |
| 167 | B | >gi|417347175|gb|AFX60234.1 |
| 168 | B | >gi|464405988|gb|AAS93662.1 |
| 169 | B | >gi|138250|sp|P13843.1 |
| 170 | B | >gi|2582041|gb|AAB82446.1 |
| 171 | B | >gi|9629206|ref|NP_056863.1 |
| 172 | B | >gi|38230490|gb|AAR14266.1 |
| 173 | B | >gi|326578292|gb|ADZ95775.1 |
| 174 | B | >gi|345121416|gb|AEN74944.1 |
| 175 | B | >gi|345121418|gb|AEN74945.1 |
| 176 | B | >gi|464405994|gb|AAS93665.1 |
| 177 | B | >gi|380235896|gb|AFD34264.1 |
| 178 | Bovine | >gi|138247|sp|P22167.1 |
| 179 | Bovine | >gi|3451386|emb|CAA76980.1 |
| 180 | Bovine | >gi|1793999|gb|AAL49399.1 |
| 181 | Bovine | >gi|9631275|ref|NP_048055.1 |
| 182 | Bovine | >gi|9438413|emb|CAI96787.1 |
| 183 | Bovine | >gi|425678|gb|AAB28458.1 |
| 184 | Bovine | >gi|1794000|gb|AAL49410.1 |

The RSV F protein exhibits remarkable sequence conservation across RSV subtypes (see Table 3, which shows average pairwise sequence identity across subtypes and F protein segments). For example, RSV subtypes A and B share 90% sequence identity, and RSV subtypes A and B each share 81% sequence identify with bRSV F protein, across the $F_0$ precursor molecule. Within RSV subtypes the $F_0$ sequence identity is even greater; for example within each of RSV A, B, and bovine subtypes, the RSV $F_0$ precursor protein has ~98% sequence identity. Nearly all identified RSV $F_0$ precursor proteins are approximately 574 amino acids in length, with minor differences in length typically due to the length of the C-terminal cytoplasmic tail. Sequence identity across RSV F proteins is illustrated in Table 4:

TABLE 4

RSV F protein sequence identity

| RSV subtype | hRSV A (SEQ NOs: 1-128) | hRSV B (SEQ NOs: 129-177) | bRSV (SEQ NOs: 178-184) |
|---|---|---|---|
| $F_0$ (positions 1-574) | | | |
| hRSV A (SEQ NOs: 1-128) | 98% | — | — |
| hRSV B (SEQ NOs: 129-177) | 90% | 99% | — |
| Bovine RSV (SEQ NOs: 178-184) | 81% | 81% | 98% |
| $F_2$ (positions 26-109) | | | |
| hRSV A (SEQ NO: 1-128) | 98% | — | — |
| hRSV B (SEQ NO: 129-177) | 93% | 99% | — |
| Bovine RSV (SEQ NOs: 178-184) | 77% | 77% | 98% |
| $F_1$ (positions 137-513) | | | |
| hRSV A (SEQ NOs: 1-128) | 99% | — | — |
| hRSV B (SEQ NOs: 129-177) | 95% | >99% | — |
| Bovine RSV (SEQ NOs: 178-184) | 91% | 92% | 99% |

In view of the conservation of RSV F sequences, the person of ordinary skill in the art can easily compare amino acid positions between different native RSV F sequences, to identify corresponding RSV F amino acid positions between different RSV strains and subtypes. For example, across nearly all identified native RSV $F_0$ precursor proteins, the furin cleavage sites fall in the same amino acid positions. Thus, the conservation of RSV F protein sequences across strains and subtypes allows use of a reference RSV F sequence for comparison of amino acids at particular positions in the RSV F protein. For the purposes of this disclosure (unless context indicates otherwise), RSV F protein amino acid positions are given with reference to the reference $F_0$ protein precursor polypeptide set forth as SEQ ID NO: 124 (corresponding to GENBANK® Acc. No. P03420, incorporated by reference herein as present in GENBANK® on Feb. 28, 2013).

B. PreF Antigens

Isolated antigens are disclosed herein that include a recombinant RSV F protein stabilized in a prefusion conformation ("PreF antigens"). The PreF antigens contain a recombinant RSV F protein or fragment thereof that has been modified from a native form to increase immunogenicity. For example, the disclosed recombinant RSV F proteins have been modified from the native RSV sequence to be stabilized in a prefusion conformation. The person of ordinary skill in the art will appreciate that the disclosed PreF antigens are useful to induce immunogenic responses in vertebrate animals (such as mammals, for example, humans and cattle) to RSV (for example RSV A, RSV B, or bovine RSV). Thus, in several embodiments, the disclosed antigens are immunogens.

The D25 antibody recognizes a quaternary epitope including multiple protomers of the RSV F protein. This epitope is contained within an antigenic site ("Antigenic site Ø") located on the membrane-distal apex of the RSV F glycoprotein (see, e.g., FIG. 1C), when it is in a prefusion conformation. While the secondary structural elements of the this epitope remains mostly unchanged between pre- and post-fusion F conformations, their relative orientation changes substantially, with the α4-helix pivoting ~180° relative to strand β2 in pre- and post-fusion conformations (see, e.g., FIG. 3B). The conformational changes in the structure of the RSV F protein between the pre- and post-fusion conformations determine the presence of the D25 epitope on the RSV F protein. Accordingly, in several embodiments, a PreF antigen including a recombinant RSV F protein stabilized in a prefusion conformation can be identified by determining the specific binding of the D25 monoclonal antibody to the antigen. The person of ordinary skill in the art will appreciate that other antibodies that specifically bind to antigenic site Ø of the RSV F protein (such as the AM22 antibody or 5C4 antibody), or other antibodies that are pre-fusion specific, but do not bind antigenic site Ø (such as MPE8) can also be used to identify a PreF antigen including a RSV F protein stabilized in a prefusion conformation.

Thus, the PreF antigens disclosed herein are specifically bound by an antibody that is specific for the RSV F prefusion conformation but not the post-fusion conformation. In several embodiments, the PreF antigen is specifically bound by the D25 and/or AM22 antibody, which (as disclosed herein) are antibodies specific for the pre- but not post-fusion conformation of the RSV F protein. In several examples, the prefusion-specific antibody (such as D25 or AM22) specifically binds to the PreF antigen with a dissociation constant of less than about $10^{-6}$ Molar, such as less than about $10^{-7}$ Molar, $10^{-8}$ Molar, or less than $10^{-9}$ Molar. Specific binding can be determined by methods known in the art. The determination of specific binding may readily be made by using or adapting routine procedures, such as ELISA, immunocompetition, surface plasmon resonance, or other immunosorbent assays (described in many standard texts, including Harlow and Lane, *Using Antibodies: A Laboratory Manual*, CSHL, New York, 1999).

In further embodiments, the PreF antigen is not specifically bound by an antibody that binds the postfusion conformation of the RSV F protein. For example, an antibody specific for the six helix bundle found only in the postfusion conformation of RSV F protein (e.g., as described in Magro et al., *Proc. Nat'l. Acad. Sci. U.S.A.*, 109:3089-3094, 2012). In several examples, the dissociation constant for the RSV F postfusion specific antibody binding to the PreF antigen is greater than $10^{-5}$ Molar, such as at least $10^{-5}$ Molar, $10^{-4}$ Molar, or $10^{-3}$.

In several embodiments, any of the PreF antigens includes a RSV F protein prefusion epitope (such as a D25 or AM22 epitope) in a RSV F protein prefusion-specific antibody-bound conformation (such as a D25 or AM22 bound conformation). For example, in several embodiments, any of the PreF antigens includes an epitope in a D25 or AM22 epitope-bound confirmation (e.g., the conformation defined by the structural coordinates provided in Table 1) when the PreF antigen is not bound by D25 or AM22, that is, the PreF antigen is stabilized in the D25- or AM22-bound conformation. Methods of determining if a disclosed PreF antigen includes a RSV F protein prefusion epitope (such as a D25 or AM22 epitope) in a RSV F protein prefusion specific monoclonal antibody-bound conformation (such as a D25 or AM22 bound conformation) are known to the person of ordinary skill in the art and further disclosed herein (see, for example, McLellan et al., *Nature*, 480:336-343, 2011; and U.S. Patent Application Publication No. 2010/0068217, each of which is incorporated by reference herein in its entirety). For example, the disclosed three-dimensional structure of the D25 Fab fragment in complex with the RSV F protein can be compared with three-dimensional structure of any of the disclosed PreF antigens.

The person of ordinary skill in the art will appreciate that a disclosed PreF antigen can include an epitope in a prefusion specific monoclonal antibody-bound conformation even though the structural coordinates of antigen are not strictly identical to those of the prefusion F protein as disclosed herein. For example, in several embodiments, any of the disclosed PreF antigens include a RSV F prefusion-specific epitope (such as a D25 or AM22 epitope) that in the absence of the RSV F prefusion specific monoclonal antibody can be structurally superimposed onto the corresponding epitope in complex with the RSV F prefusion specific monoclonal antibody with a root mean square deviation (RMSD) of their coordinates of less than 1.0, 0.75, 0.5, 0.45, 0.4, 0.35, 0.3 or 0.25 Å/residue, wherein the RMSD is measured over the polypeptide backbone atoms N, Cα, C, O, for at least three consecutive amino acids.

In several embodiments, the PreF antigen is soluble in aqueous solution. For example, in some embodiments, the PreF antigen is soluble in a solution that lacks detergent. In some embodiments, the PreF antigen dissolves to a concentration of at least 0.5 mg/ml (such as at least 1.0 mg/ml, 1.5 mg/ml, 2.0 mg/ml, 3.0 mg/ml, 4.0 mg/ml or at least 5.0 mg/ml) in phosphate buffered saline (pH 7.4) at room temperature (e.g., 20-22 degrees Celsius) and remains dissolved for at least for at least 12 hours (such as at least 24 hours, at least 48 hours, at least one week, at least two weeks, or more time). In one embodiment, the phosphate buffered saline includes NaCl (137 mM), KCl (2.7 mM), $Na_2HPO_4$ (10 mM), $KH_2PO_4$ (1.8 mM) at pH 7.4. In some embodiments, the phosphate buffered saline further includes $CaCl_2$ (1 mM) and $MgCl_2$ (0.5 mM). The person of skill in the art is familiar with methods of determining if a protein remains in solution over time. For example, the concentration of the protein dissolved in a aqueous solution can be tested over time using standard methods.

In several embodiments, any of the disclosed PreF antigens can be used to induce an immune response to RSV in a subject. In several such embodiments, induction of the immune response includes production of neutralizing antibodies to RSV. Methods to assay for neutralization activity are known to the person of ordinary skill in the art and further described herein, and include, but are not limited to, plaque reduction neutralization (PRNT) assays, microneutralization assays (see e.g., Anderson et al., *J. Clin. Microbiol.*, 22: 1050-1052, 1985), or flow cytometry based assays (see, e.g., Chen et al., *J. Immunol. Methods.*, 362:180-184, 2010). Additional neutralization assays are described herein, and familiar to the person of ordinary skill in the art.

In some embodiments, the PreF antigen includes a recombinant RSV F protein that, when dissolved in an aqueous solution, forms a population of recombinant RSV F proteins stabilized in a prefusion conformation. The aqueous solution can be, for example, phosphate buffered saline at physiological pH, such as pH 7.4. In some embodiments, the population is a homogeneous population including one or more recombinant RSV F proteins that are, for example, all stabilized in a prefusion conformation. In some embodiments, at least about 90% of the recombinant RSV F proteins (such as at least about 91%, 92%, 93%, 94%, 95%, 96%, 97%, 98%, 99% or 99.9% of the RSV F proteins) in the homogeneous population are stabilized in the prefusion conformation. In some embodiments, at least about 90% of the recombinant RSV F proteins (such as at least about 91%, 92%, 93%, 94%, 95%, 96%, 97%, 98%, 99% or 99.9% of the RSV F proteins) in the homogeneous population are specifically bound by a prefusion-specific antibody (e.g., D25 or AM22 antibody), and/or include a RSV F prefusion specific conformation (such as antigenic site Ø). It will be understood that a homogeneous population of RSV F proteins in a particular conformation can include variations (such as protein modification variations, e.g., glycosylation state), that do not alter the conformational state of the RSV F protein. In several embodiments, the population of recombinant RSV F protein remains homogeneous over time. For example, the PreF antigen can include a recombinant RSV F protein that, when dissolved in aqueous solution, forms a population of recombinant RSV F proteins that is stabilized in a prefusion conformation for at least 12 hours, such as at least 24 hours, at least 48 hours, at least one week, at least two weeks, or more.

In several embodiments, the isolated PreF antigens are substantially separated from RSV F proteins in a post-fusion conformation. Thus, the PreF antigen can be, for example, at least 80% isolated, at least 90%, 95%, 98%, 99%, or even 99.9% separated from RSV F proteins in a postfusion conformation. In several embodiments, the PreF antigens are also separated from RSV F proteins that do not include antigen site Ø and/or are not specifically bound by a prefusion specific monoclonal antibody (such as D25 or AM22). For example, the PreF antigen can be at least 80% isolated, at least 90%, 95%, 98%, 99%, or even 99.9% separated from RSV F proteins that do not include antigen site Ø and/or are not specifically bound by a prefusion specific monoclonal antibody (such as D25 or AM22).

In some embodiments, the PreF antigen includes a recombinant RSV F protein that, when incubated in an aqueous solution, forms a population of recombinant RSV F proteins stabilized in a prefusion conformation, wherein at least 70% (such as at least 80%, or at least 90% or at least 95% or at least 98%) of the isolated antigens in the population specifically bind to a RSV F protein prefusion-specific antibody (such as D25 or AM22) after (a) incubation for one hour in 350 mM NaCl pH 7.0, at 50° C.;
(b) incubation for one hour in 350 mM NaCl pH 3.5, at 25° C.;
(c) incubation for one hour in 350 mM NaCl pH 10, at 25° C.;
(d) incubation for one hour in 10 mM osmolarity, pH 7.0, at 25° C.;
(e) incubation for one hour in 3000 mM osmolarity, pH 7.0, at 25° C.;
(g) a combination of two or more of (a)-(e); or
a combination of (a) and (b); (a) and (c); (a) and (d); (a) and (e); (b) and (d); (b) and (e); (c) and (d); (c) and (e); (a), (b), and (d); (a), (c), and (d); (a), (b), and (e); or (a), (c), and (e)

In further embodiments, the PreF antigen includes a recombinant RSV F protein that, when incubated in an aqueous solution, forms a population of recombinant RSV F proteins stabilized in a prefusion conformation, wherein at least 60% (such as at least 70%, at least 80%, or at least 90%) of the isolated antigens in the population specifically bind to the prefusion-specific antibody after ten freeze-thaw cycles in 350 mM NaCl pH 7.0.

In some embodiments, the PreF antigens are provided as a homogenous population that does not include detectable RSV F protein in a post-fusion conformation. RSV F protein is detectable by negative stain electron microscope and/or specific binding by a postfusion antibody.

1. Recombinant RSV F Proteins Stabilized in a Prefusion Conformation

The PreF antigens disclosed herein include a recombinant RSV F protein stabilized in a prefusion conformation and include an $F_1$ polypeptide and a $F_2$ polypeptide. The $F_1$ polypeptide, $F_2$ polypeptide, or both, can include at least one modification (e.g., an amino acid substitution) that stabilizes the recombinant RSV F protein in its prefusion conformation. In several embodiments, the $F_2$ polypeptide and the $F_1$ polypeptide are linked by a peptide linker (for example, in embodiments including a single chain RSV F protein). Stabilization of the recombinant RSV F protein in the prefusion conformation preserves at least one prefusion-specific epitope (i.e., an epitope present in the pre- (but not post-) fusion conformation of the RSV F protein) that specifically binds to a RSV F prefusion-specific monoclonal antibody (i.e., an antibody that specifically binds to the RSV F protein in a prefusion conformation, but not a post fusion conformation). Thus, the disclosed PreF antigens are specifically bound by a prefusion-specific antibody (e.g., D25 or AM22 antibody), and/or includes a RSV F prefusion specific conformation (such as antigenic site Ø).

In some examples, the PreF antigen includes a recombinant RSV F protein including a $F_1$ and/or $F_2$ polypeptide from a RSV A virus, for example, a $F_1$ and/or $F_2$ polypeptide from a RSV $F_0$ protein provided as one of SEQ ID NOs: 1-128, or 370, that is modified to stabilize the recombinant RSV F protein in a prefusion conformation. In some examples, the PreF antigen includes a recombinant RSV F protein including a $F_1$ and/or $F_2$ polypeptide from a RSV B virus, for example, a $F_1$ and/or $F_2$ polypeptide from a RSV $F_0$ protein provided as one of SEQ ID NOs: 129-177, that is modified to stabilize the recombinant RSV F protein in a prefusion conformation. In some examples, the PreF antigen includes a recombinant RSV F protein including a $F_1$ and/or $F_2$ polypeptide from a RSV bovine virus, for example, a $F_1$ and/or $F_2$ polypeptide from a RSV $F_0$ protein provided as one of SEQ ID NOs: 178-184, that is modified to stabilize the recombinant RSV F protein in a prefusion conformation. $F_1$ and/or $F_2$ polypeptides from other RSV subtypes can also be used. The recombinant RSV F protein can include modifications of the native RSV sequences, such as amino acid substitutions, deletions or insertions, glycosylation and/or covalent linkage to unrelated proteins (e.g., a protein tag), as long as the PreF antigen retains the recombinant RSV F protein stabilized in a prefusion conformation. RSV F proteins from the different RSV subgroups, as well as nucleic acid sequences encoding such proteins and methods for the manipulation and insertion of such nucleic acid sequences into vectors, are disclosed herein and known in the art (see, e.g., Tan et al., PLOS one, 7: e51439, 2011; Sambrook et al., Molecular Cloning, a Laboratory Manual, 2d edition, Cold Spring Harbor Press, Cold Spring Harbor, N.Y. (1989); Ausubel et al., Current Protocols in Molecular Biology, Greene Publishing Associates and John Wiley & Sons, New York, N.Y. (1994)).

In some embodiments, the recombinant RSV F protein comprises or consists of a $F_2$ polypeptide and a $F_1$ polypeptide comprising amino acid sequences at least 80% identical to amino acids 26-103 and 145-310, respectively, of a native RSV F protein sequence set forth as any one of SEQ ID NOs: 1-184, such as SEQ ID NO: 124.

In some embodiments, the recombinant RSV F protein comprises or consists of a $F_2$ polypeptide and a $F_1$ polypeptide comprising amino acid sequences at least 80% (such as at least 90%, at least 95%, at least 98%, or even 100%) identical to amino acids 26-103 and 145-513, respectively, of a native RSV F protein sequence set forth as any one of SEQ ID NOs: 1-184, such as SEQ ID NO: 124.

In some embodiments, the recombinant RSV F protein comprises or consists of a $F_2$ polypeptide and a $F_1$ polypeptide comprising amino acid sequences at least 80% (such as at least 90%, at least 95%, at least 98%, or even 100%) identical to amino acids 26-103 and 145-529, respectively, of a native RSV F protein sequence set forth as any one of SEQ ID NOs: 1-184, such as SEQ ID NO: 124.

In some embodiments, the recombinant RSV F protein comprises or consists of a $F_2$ polypeptide and a $F_1$ polypeptide comprising amino acid sequences at least 80% (such as at least 90%, at least 95%, at least 98%, or even 100%) identical to amino acids 26-103 and 145-551, respectively, of a native RSV F protein sequence set forth as any one of SEQ ID NOs: 1-184, such as SEQ ID NO: 124.

In some examples, the PreF antigen includes a recombinant RSV F protein including a $F_1$ and/or $F_2$ polypeptide including a polypeptide sequences having at least 75% (for example at least 85%, 90%, 95%, 96%, 97%, 98% or 99%) sequence identity with a RSV $F_1$ and/or $F_2$ polypeptide from a RSV A virus, for example, a $F_1$ and/or $F_2$ polypeptide from a RSV $F_0$ protein provided as one of SEQ ID NOs: 1-128 or 370. In further examples, the PreF antigen includes a recombinant RSV F protein including a $F_1$ and/or $F_2$ polypeptide including a polypeptide sequences having at least 75% (for example at least 85%, 90%, 95%, 96%, 97%, 98% or 99%) sequence identity with a RSV $F_1$ and/or $F_2$ polypeptide from a RSV B virus, for example, a $F_1$ and/or $F_2$ polypeptide from a RSV $F_0$ protein provided as one of SEQ ID NOs: 129-177. In further examples, the PreF antigen includes a recombinant RSV F protein including a $F_1$ and/or $F_2$ polypeptide including a polypeptide sequences having at least 75% (for example at least 85%, 90%, 95%, 96%, 97%, 98% or 99%) sequence identity with a RSV $F_1$ and/or $F_2$ polypeptide from a RSV bovine virus, for example, a $F_1$ and/or $F_2$ polypeptide from a RSV $F_0$ protein provided as one of SEQ ID NOs: 178-184.

In several embodiments, the PreF antigen includes a recombinant RSV F protein including a $F_1$ polypeptide including or consisting of at least 300 consecutive amino acids (such as at least 310, 320, 330, 340, 350, 360, 370, 380, 390, 400, 410, 420, or 430 consecutive amino acids) from a native $F_1$ polypeptide sequence, such as positions 137-513 of one of SEQ ID NOs: 1-184 or 370, including any polypeptide sequences having at least 75% (for example at least 80%, 81%, 82%, 83%, 84%, 85%, 86%, 87%, 88%, 89%, 90%, 91%, 92%, 93%, 94%, 95%, 96%, 97%, 98% or 99%) sequence identity to a native $F_1$ polypeptide sequence, such as positions 137-513 of any one of SEQ ID NOs: 1-184 or 370. For example, in some embodiments, the PreF antigen includes a recombinant F protein includes a $F_1$ polypeptide including or consisting of positions 137-513, 137-481, 137-491, or position 137 to the C-terminus, or positions 137—to the transmembrane domain, of any one of SEQ ID NOs: 1-184 or 370, including any polypeptide sequences having at least 75% (for example at least 85%, 90%, 95%, 96%, 97%, 98% or 99%) sequence identity to a native $F_1$ polypeptide sequence, such as positions 137-513, or position 137 to the C-terminus, or positions 137—to the transmembrane domain, any one of SEQ ID NOs: 1-184 or 370. The person of ordinary skill in the art will appreciate that the PreF antigen including the recombinant RSV F protein can include a F1 polypeptide with N- or C-terminal truncations (for example, deletion of 1, 2, 3, 4, 5, 6, 7, 8, 9, 10, 15, 20, 25, 30, 35, 40, 45, or 50 or more amino acids) compared to extracellular region of a native F1 polypeptide (for example, positions 137-524), as long as the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a $F_1$ polypeptide including a maximum length, for example no more than 300, 310, 320, 330, 340, 350, 360, 370, 380, 390, 400, 410, 420, 430, or no more than 440 amino acids in length. The $F_1$ polypeptide may include, consist or consist essentially of the disclosed sequences. The disclosed contiguous $F_1$ polypeptide sequences may also be joined at either end to other unrelated sequences (for examiner, non-RSV $F_1$ protein sequences, non-RSV F protein sequences, non-RSV, non-viral envelope, or non-viral protein sequences)

In several embodiments, the PreF antigen includes a recombinant RSV F protein including a $F_2$ polypeptide including or consisting of at least 60 consecutive amino acids (such as at least 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108 or 109 consecutive amino acids) from a native $F_2$ polypeptide sequence, such as positions 26-109 of any one of SEQ ID NOs: 1-184 or 370, including a polypeptide sequences having at least 75% (for example at least 85%, 90%, 95%, 96%, 97%, 98% or 99%) sequence identity to a native $F_1$ polypeptide sequence, such as positions 26-109 any one of SEQ ID NOs: 1-184 or 370. For example, in some embodiments, the PreF antigen includes a recombinant F protein including a $F_2$ polypeptide including or consisting of 70-109 consecutive amino acids (such as 60-100, 75-95, 80-90, 75-85, 80-95, 81-89, 82-88, 83-87, 83-84, or 84-85 consecutive amino acids) from a native $F_2$ polypeptide sequence, such as positions 26-109 any one of SEQ ID NOs: 1-184 or 370, including any polypeptide sequences having at least 75% (for example at least 85%, 90%, 95%, 96%, 97%, 98% or 99%) sequence identity to a native $F_2$ polypeptide sequence, such as positions 137-513 any one of SEQ ID NOs: 1-184 or 370.

In some embodiments, the PreF antigen includes a $F_2$ polypeptide is also of a maximum length, for example no more than 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids in length. The $F_2$ polypeptide may include, consist or consist essentially of the disclosed sequences. The disclosed contiguous $F_2$ polypeptide sequences may also be joined at either end to other unrelated sequences (for examiner, non-RSV F2 protein sequences, non-RSV F protein sequences, non-RSV, non-viral envelope, or non-viral protein sequences).

In some embodiments, the PreF antigen includes a recombinant RSV F protein including a $F_2$ polypeptide including or consisting of at least 60 consecutive amino acids (such as at least 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108 or 109 consecutive amino acids) from a native $F_2$ polypeptide sequence, such as positions 26-109 of any one of SEQ ID NOs: 1-184 or 370, including polypeptide sequences having at least 75% (for example at least 85%, 90%, 95%, 96%, 97%, 98% or 99%) sequence identity to a native $F_2$ polypeptide sequence, such as amino acids 26-109 any one of SEQ ID NOs: 1-184 or 370, and further includes a $F_1$ polypeptide including or consisting of at least 300 consecutive amino acids (such as at least 310, 320, 330, 340, 350, 360, 370, 380, 390, 400, 410, 420, or 430 consecutive amino acids) from a native $F_1$ polypeptide sequence, such as positions 137-513 of one of SEQ ID NOs: 1-184 or 370, including any polypeptide sequences having at least 75% (for example at least 80%, 81%, 82%, 83%, 84%, 85%, 86%, 87%, 88%, 89%, 90%, 91%, 92%, 93%, 94%, 95%, 96%, 97%, 98% or 99%) sequence identity to a native $F_1$ polypeptide sequence, such as positions 137-513 of any one of SEQ ID NOs: 1-184 or 370.

In one non-limiting example, the PreF antigen includes a recombinant RSV F protein including a F2 polypeptide and a $F_1$ polypeptide including positions 26-109 and 137-513, respectively, of any one of SEQ ID NOs: 1-184 or 370, including polypeptide sequences having at least 75% (for example at least 85%, 90%, 95%, 96%, 97%, 98% or 99%) sequence identity to a positions 26-109 and 137-513, respectively, of any one of SEQ ID NOs: 1-184 or 370.

As noted above, the RSV F protein is initially synthesized as a $F_0$ precursor protein and is cleaved at multiple sites (including two conserved furin cleavage sites) during maturation in eukaryotic cells. Thus, the native RSV F protein lacks the N-terminal signal peptide and the pep27 peptide (or a portion thereof) of the $F_0$ precursor protein. In several embodiments, the disclosed recombinant RSV F proteins stabilized in the prefusion conformation do not include the signal peptide (or a portion thereof) and/or do not include the pep27 peptide (or a portion thereof). The person of ordinary skill in the art will appreciate that recombinant RSV F proteins lacking the RSV F signal peptide and/or pep27 peptide can be generated by expressing the recombinant $F_0$ polypeptide in cells where the signal peptide and the pep27 peptide will be excised from the $F_0$ precursor by cellular proteases.

Several embodiments include a PreF antigen including a multimer of any of the disclosed recombinant RSV F proteins, for example, a multimer including 2, 3, 4, 5, 6, 7, 8, 9, or 10 or more of the disclosed recombinant RSV F proteins. In several examples, any of the disclosed recombinant RSV F proteins can be linked (e.g., via a peptide linker) to another of the recombinant RSV F proteins to form the multimer.

It is understood in the art that some variations can be made in the amino acid sequence of a protein without affecting the activity of the protein. Such variations include insertion of amino acid residues, deletions of amino acid residues, and substitutions of amino acid residues. These variations in sequence can be naturally occurring variations or they can be engineered through the use of genetic engineering technique known to those skilled in the art. Examples of such techniques are found in Sambrook J, Fritsch E F, Maniatis T et al., in Molecular Cloning—A Laboratory Manual, 2nd Edition, Cold Spring Harbor Laboratory Press, 1989, pp. 9.31-9.57), or in Current Protocols in Molecular Biology, John Wiley & Sons, N.Y. (1989), 6.3.1-6.3.6, both of which are incorporated herein by reference in their entirety. Thus, in some embodiments, the PreF antigen includes a $F_1$ polypeptide, a $F_2$ polypeptide, or both a $F_1$ and $F_2$ polypeptide, that include one or more amino acid substitutions compared to the corresponding native RSV sequence. For example, in some embodiments, the $F_1$ polypeptide, $F_2$ polypeptide, or both the $F_1$ polypeptide and the $F_2$ polypeptide, include up to 20 (such as up to 1, 2, 3, 4, 5, 6, 7, 8, 9, 10, 11, 12, 13, 14, 15, 16, 17, 18, or 19) amino acid substitutions compared to a native $F_1$ polypeptide sequence, such as a native RSV sequence set forth as any one of SEQ ID NOs: 1-184 or 370, wherein the PreF antigen is specifically bound by a RSV F prefusion-specific antibody (e.g., D25 or AM22 antibody), and/or includes a RSV F prefusion specific conformation (such as antigenic site Ø). In additional embodiments, the $F_1$ polypeptide, $F_2$ polypeptide, or both the $F_1$ polypeptide and the $F_2$ polypeptide, include up to 20 (such as up to 1, 2, 3, 4, 5, 6, 7, 8, 9, 10, 11, 12, 13, 14, 15, 16, 17, 18, or 19) conservative amino acid substitutions compared to a native $F_1$ polypeptide sequence, such as a native RSV sequence set forth as any one of SEQ ID NOs: 1-184 or 370, wherein the PreF antigen is specifically bound by a RSV F prefusion-specific antibody (e.g., D25 or AM22 antibody), and/or includes a RSV F prefusion specific conformation (such as antigenic site Ø). For example, in some embodiments, the PreF antigen includes a recombinant RSV F protein in a prefusion conformation that is modified to increase expression of the protein for protein productions purposes, e.g., by elimination of one or more nuclear localization signals present on the RSV F protein. Manipulation of the nucleotide sequence encoding the $F_1$ or $F_2$ polypeptide sequence (such as a nucleotide sequence encoding the $F_0$ polypeptide including the $F_1$ and $F_2$ polypeptides) using standard procedures, including in one specific, non-limiting, embodiment, site-directed mutagenesis or in another specific, non-limiting, embodiment, PCR, can be used to produce such variants. Alternatively, the $F_1$ and $F_2$ polypeptides can be synthesized using standard methods. The simplest modifications involve the substitution of one or more amino acids for amino acids having similar biochemical properties. These so-called conservative substitutions are likely to have minimal impact on the activity of the resultant protein.

a. Membrane Distal Stabilizing Modifications

As disclosed herein, the RSV F protein undergoes a structural rearrangement between its pre- and post-fusion conformations. As shown in FIG. 2B, the N-terminal region of the $F_1$ polypeptide in the prefusion conformation (corresponding in part to the membrane distal lobe shown in FIG. 2A) includes the indicated α2, α3, β3, β4, and α4 helical and beta sheet structures, whereas the corresponding region of the N-terminus of the $F_1$ polypeptide in the postfusion structure includes an extended α5 helical structure—the α2, α3, β3, β4, and α4 helical and beta sheet structures are absent. Further, the C-terminal region of the $F_1$ polypeptide in the prefusion conformation (corresponding in part to the membrane proximal lobe shown in FIG. 2A) includes the indicated β22, α9, and β23 beta sheet and helical structures, whereas the corresponding C-terminal region of the $F_1$ polypeptide in the postfusion conformation structure includes an extended α10 helical structure and extended coil—the β22, α9, and β23 beta sheet and helical structures are absent. Thus, the membrane distal and membrane proximal lobes of the RSV F protein in its prefusion conformation include several distinct structural elements that are absent from the corresponding regions of the RSV F protein in its postfusion conformation.

Guided by the structural features identified in the pre- and post-fusion conformations of the RSV F protein, several modes of stabilizing the RSV F protein in a prefusion conformation are available, including amino acid substitutions that introduce one or more non-natural disulfide bonds, fill cavities within the RSV F protein, alter the packing of residues in the RSV F protein, introduce N-linked glycosylation sites, and combinations thereof. The stabilize modifications provided herein are targeted modifications that stabilize the recombinant RSV F protein in the prefusion conformation. In several embodiments, the RSV F protein is not stabilized by non-specific cross-linking, such as glutaraldehyde crosslinking, for example glutaraldehyde crosslinking of membrane bound RSV F trimers.

In some non-limiting embodiments, the PreF antigen includes a recombinant RSV F protein stabilized in a prefusion conformation by introduction of a disulfide bond, wherein the recombinant RSV F protein includes S155C and S290C; G151C and I288C; A153C and K461C; A149C and Y458C; G143C and S404S substitutions; or Y33C and V469C amino acid substitutions. Non-limiting examples of precursor proteins of such recombinant RSV F proteins (including a Foldon domain linked to the C-terminus of the F1 polypeptide) are set forth herein as SEQ ID NO: 185, SEQ ID NO: 189, SEQ ID NO: 205, SEQ ID NO: 207, SEQ ID NO: 209, and SEQ ID NO: 211. In further non-limiting embodiments, the PreF antigen includes a recombinant RSV F protein stabilized in a prefusion conformation by introduction of a disulfide bond and one or more cavity filling substitutions, wherein the recombinant RSV F protein includes S155C, S290C substitutions, and a large hydrophobic residue at position 190, and/or position 207 (e.g., a S190F, S190W, or S190L substation, and/or a V207L, V207F, or V207W substitution). Non-limiting examples of precursor proteins of such recombinant RSV F precursor proteins (including a foldon domain linked to the C-terminus of the F1 polypeptide) are set forth herein as SEQ ID NO: 371, SEQ ID NO: 372, SEQ ID NO: 373, SEQ ID NO: 374, SEQ ID NO: 375, and SEQ ID NO: 376.

Many of the sequences of recombinant RSV F proteins disclosed herein include the sequence of protease cleavage sites (such as thrombin sites), protein tags (such as a His tag, a Strep Tag II, a Avi tag, etc., that are not essential for the function of the RSV F protein, such as for induction of an immune response in a subject. The person of ordinary skill in the art will recognize such sequences, and when appropriate, understand that these tags or protease cleavage sites are not included in a disclosed recombinant RSV F protein.

i. Non-Natural Disulfide Bonds

In several embodiments, the PreF antigen includes a recombinant RSV F protein stabilized in a prefusion conformation by at least one non-natural disulfide bond including a pair of cross-linked cysteine residues. A non-natural disulfide bond is one that does not occur in a native RSV F protein, and is introduced by protein engineering (e.g., by including one or more substituted cysteine residues that form the non-natural disulfide bond). For example, in some embodiments, any of the disclosed recombinant RSV F protein is stabilized in a prefusion conformation by any one of 1, 2, 3, 4, 5, 6, 7, 8, 9, or 10 disulfide bonds including a pair of cross-linked cysteine residues. In one specific non-limiting example, the recombinant RSV F protein is stabilized in a prefusion conformation by a single pair of cross-linked cysteine residues. In another non-limiting example, any of the disclosed recombinant RSV F protein is stabilized in a prefusion conformation by two pairs of crosslinked cysteine residues.

The cysteine residues that form the disulfide bond can be introduced into native RSV F protein sequence by one or more amino acid substitutions. For example, in some embodiments, a single amino acid substitution introduces a cysteine that forms a disulfide bond with a cysteine residue present in the native RSV F protein sequence. In additional embodiments, two cysteine residues are introduced into a native RSV sequence to form the disulfide bond. The location of the cysteine (or cysteines) of a disulfide bond to stabilize the RSV F protein in a prefusion conformation can readily be determined by the person of ordinary skill in the art using the disclosed structure of RSV F protein in its prefusion conformation, and the previously identified structure of RSV F protein in its post fusion conformation.

For example, the amino acid positions of the cysteines are typically within a sufficiently close distance for formation of a disulfide bond in the prefusion conformation of the RSV F protein. Methods of using three-dimensional structure data to determine if two residues are within a sufficiently close distance to one another for disulfide bond formation are known (see, e.g., Peterson et al., *Protein engineering*, 12:535-548, 1999 and Dombkowski, *Bioinformatics*, 19:1852-1853, 3002 (disclosing DISULFIDE BY DESIGN™), each of which is incorporated by reference herein). For example, residues can be selected manually, based on the three dimensional structure of RSV F protein in a prefusion conformation provided herein, or a software, such as DISULFIDEBYDESIGN™, can be used. Without being bound by theory, ideal distances for formation of a disulfide bond are generally considered to be about ~5.6 Å for Cα-Cα distance, ~2.02 Å for Sγ-Sγ distance, and 3.5-4.25 Å for Cβ-Cβ distance (using the optimal rotomer). The person of ordinary skill in the art will appreciate that variations from these distances are included when selecting residues in a three dimensional structure that can be substituted for cysteines for introduction of a disulfide bond. For example, in some embodiments the selected residues have a Cα-Cα distance of less than 7.0 Å and/or a Cβ-Cβ distance of less than 4.7 Å. In some embodiments the selected residues have a Cα-Cα distance of from 2.0-8.0 Å and/or a Cβ-Cβ distance of from 2.0-5.5 Å. In several embodiments, the amino acid positions of the cysteines are within a sufficiently close distance for formation of a disulfide bond in the prefusion, but not post-fusion, conformation of the RSV F protein.

The person of ordinary skill in the art can readily determine the relative position of a particular amino acid between the pre- and post-fusion conformations of the RSV F protein, for example by comparing the prefusion structures defined herein by the structural coordinates provided in Table 1, with the previously identified postfusion structure described in McLellan et al., *J. Virol.*, 85, 7788, 2011, with structural coordinates deposited as PDB Accession No. 3RRR). Methods of determining relative position of a particular amino acid between the two protein structures (e.g., between the three dimensional structures pre- and post-fusion RSV F protein) are known. For example the person of ordinary skill in the art can use known superimposition methods to compare the two structures (e.g., methods using the LSQKAB program (Kabsch W. *Acta. Cryst. A*32 922-923 (1976)). In one example, the pre- and postfusion structures can be superimposed by using LSQKAB to align F protein positions 26-60, 77-97, 220-322, and 332-459 defined by the structural coordinates provided in Table 1, with the F protein positions 26-60, 77-97, 220-322, and 332-459 defined by the structural coordinates deposited as PDB Accession No. 3RRR, and comparing the distance between the Cα atom for each residue in the pre- and post-fusion structures to identify the deviation of particular residues between the two structures.

In several embodiments, the PreF antigen includes a recombinant RSV F protein stabilized in a prefusion conformation by a disulfide bond between a cysteine introduced into an amino acid position that changes conformation, and a cysteine introduced into an amino acid position that does not change conformation, between the pre- and post-fusion structures, respectively. For example, in some embodiments, the PreF antigen includes a recombinant RSV F protein including amino acid substitutions introducing a pair of cysteines, wherein the first cysteine is in an amino acid position of the RSV F protein that has a root mean square deviation of at least 5 (such as at least 6, at least 7, at least 8, at least 9 or at least 10) angstroms between the three-dimensional structure of the RSV F protein pre- and post-fusion conformations, and the second cysteine is in an amino acid position of the RSV F protein that has a root mean square deviation of less than 4 (such as less than 3, 2, or 1) angstroms between the three-dimensional structure of the RSV F protein pre- and post-fusion conformations, wherein the PreF antigen is specifically bound by a prefusion-specific antibody (e.g., D25 or AM22 antibody), and/or includes a RSV F prefusion specific conformation (such as antigenic site Ø).

Based on a comparison of the pre- and post-fusion RSV F structures, there are at least two regions that undergo large conformational changes, located at the N- and C-termini of the $F_1$ subunit (residues 137-216 and 461-513, respectively). For example, as illustrated in FIG. 2B, the positions 137-216 and 461-513 of the $F_1$ polypeptide undergo structural rearrangement between the Pre- and Post-F protein conformations, whereas positions 217-460 of the $F_1$ polypeptide remain relatively unchanged. Thus, in some embodiments, the PreF antigen includes a recombinant RSV F protein stabilized in a prefusion conformation by a disulfide bond between a first cysteine in one of positions 137-216 or 461-513 of the $F_1$ polypeptide, and a second cysteine in one of positions 217-460 of the $F_1$ polypeptide. In further embodiments, the PreF antigen includes a recombinant RSV F protein stabilized in a prefusion conformation by a disulfide bond between a first cysteine in one of positions 137-216 or 461-513 of the $F_1$ polypeptide, and a second cysteine in a position of the $F_2$ polypeptide, such as one of positions 26-109 (for example, one of positions 26-61 or 77-97) of the $F_2$ polypeptide.

In additional embodiments, the PreF antigen includes a recombinant RSV F protein stabilized in a prefusion conformation by a disulfide bond between cysteines that are introduced into amino acid positions that change conformation between the pre- and post-fusion structures, respectively. For example, in some embodiments, the PreF antigen includes a recombinant RSV F protein including amino acid substitutions introducing a pair of cysteines, wherein the first cysteine and the second cysteine is in an amino acid position of the RSV F protein that has a root mean square deviation of at least 5 (such as at least 6, at least 7, at least 8, at least 9 or at least 10) angstroms between the three-dimensional structure of the RSV F protein pre- and post-fusion conformations, wherein the PreF antigen includes specific binding activity to an RSV F prefusion-specific antibody (e.g., D25 or AM22 antibody), and/or includes a RSV F prefusion specific epitope (e.g., a D25 or AM22 epitope). In some such embodiments, the PreF antigen includes a recombinant RSV F protein stabilized in a prefusion conformation by a disulfide bond between a the first cysteine and the second cysteine in positions 137-216 of the $F_1$ polypeptide. In additional embodiments, the PreF antigen includes a recombinant RSV F protein stabilized in a prefusion conformation by a disulfide bond between the first cysteine and the second cysteine in positions 461-513 of the $F_1$ polypeptide. In further embodiments, the PreF antigen includes a recombinant RSV F protein stabilized in a prefusion conformation by a disulfide bond between the first cysteine and the second cysteine in positions 137-216 and 461-513, respectively, of the $F_1$ polypeptide.

The person of ordinary skill in the art can readily determine the location of a particular amino acid in the pre- and post-fusion conformations of the RSV F protein (and any difference in a position between the two conformations) using the structural coordinates of the three-dimensional structure the RSV F protein in the prefusion conformation (which are set forth in Table 1), and the structural coordinates of the three-dimensional structure of the RSV F protein in the postfusion conformation (which are set forth in Protein Databank Accession No. 3RRR). For example, such comparison methods are described in Example 1. Table 5 provides examples of cysteine pairs and amino acid substitutions that can be used to stabilize a RSV F protein in a prefusion conformation.

TABLE 5

Exemplary Cysteine Pairs for Disulfide Bond Stabilization

| | F protein Residue Pair(s) for Cysteine Substitution | Substitutions corresponding to SEQ ID NO: 124 | SEQ ID NO |
|---|---|---|---|
| $F_1$ substitutions-Intra-Protomer Disulfide Bond | | | |
| 1 | 155 and 290 | S155C and S290C | 185 |
| 2 | 151 and 288 | G151C and I288C | 189 |
| 3 | 137 and 337 | F137C and T337C | 213 |
| 4 | 397 and 487 | T397C and E487C | 247 |
| 5 | 138 and 353 | L138C and P353C | 257 |
| 6 | 341 and 352 | W341C and F352C | 267 |
| 7 | 403 and 420 | S403C and T420C | 268 |
| 8 | 319 and 413 | S319C and I413C | 269 |
| 9 | 401 and 417 | D401C and Y417C | 270 |
| 10 | 381 and 388 | L381C and N388C | 271 |
| 11 | 320 and 415 | P320C and S415C | 272 |
| 12 | 319 and 415 | S319C and S415C | 273 |
| 13 | 331 and 401 | N331C and D401C | 274 |
| 14 | 320 and 335 | P320C and T335C | 275 |
| 15 | 406 and 413 | V406C and I413C | 277 |
| 16 | 381 and 391 | L381C and Y391C | 278 |
| 17 | 357 and 371 | T357C and N371C | 279 |
| 18 | 403 and 417 | S403C and Y417C | 280 |
| 19 | 321 and 334 | L321C and L334C | 281 |
| 20 | 338 and 394 | D338C and K394C | 282 |
| 21 | 288 and 300 | I288C and V300C | 284 |
| $F_2$ and $F_1$ Substitutions-Intra-Protomer Disulfide Bond | | | |
| 22 | 60 and 194 | E60C and D194C | 190 |
| 23 | 33 and 469 | Y33C and V469C | 211 |
| 24 | 54 and 154 | T54C and V154C | 212 |
| 25 | 59 and 192 | I59C and V192C | 246 |
| 26 | 46 and 311 | S46C and T311C | 276 |
| 27 | 48 and 308 | L48C and V308C | 283 |
| 28 | 30 and 410 | E30C and L410C | 285 |
| $F_1$ substitutions-Inter-Protomer Disulfide Bond | | | |
| 29 | 400 and 489 | T400C and D489C | 201 |
| 30 | 144 and 406 | V144C and V406C | 202 |
| 31 | 153 and 461 | A153C and K461C | 205 |
| 32 | 149 and 458 | A149C and Y458C | 207 |
| 33 | 143 and 404 | G143C and S404S | 209 |
| 34 | 346 and 454 | S346C and N454C | 244 |
| 35 | 399 and 494 | K399C and Q494C | 245 |
| 36 | 146 and 407 | S146C and I407C | 264 |
| 37 | 374 and 454 | T374C and N454C | 265 |
| 38 | 369 and 455 | T369C and T455C | 266 |
| 39 | 402 and 141 | V402C and L141C | 302 |
| $F_2$ and $F_1$ Substitutions-Inter-Protomer Disulfide Bond | | | |
| 40 | 74 and 218 | A74C and E218C | 243 |
| Amino acid insertions to orient the Disulfide bond | | | |
| 41 | 145 and 460 (Inter), AA insertion between positions 146 and 147 | S145C and 460C; AA insertion between positions 146/147 | 338 |
| 42 | 183 and 423 (Inter), AAA insertion between positions 182 and 183 | N183C and K423C; AAA insertion between positions 182/183 | 339 |

TABLE 5-continued

Exemplary Cysteine Pairs for Disulfide Bond Stabilization

| | F protein Residue Pair(s) for Cysteine Substitution | Substitutions corresponding to SEQ ID NO: 124 | SEQ ID NO |
|---|---|---|---|
| 43 | 330 and 430 (Inter); CAA insertion between positions 329 and 330 Combinations | A329C and S430C; and a CAA insertion between positions 329 and 330 | 340 |
| 44 | 155 and 290 (Intra); and 402 and 141 (Inter) | S155C and S290C; and V402C and L141C | 303 |
| 45 | 155 and 290(Intra); and 74 and 218 | S155C and S290C; and A74C and E218C | 263 |
| 46 | 155 and 290 (Intra); and 146 and 460 (Inter); G insertion between position 460 and 461 | S155C and S290C; and S146C and N460C; G insertion between position 460 and 461 | 258 |
| 47 | 155 and 290 (Intra); and 345 and 454(Inter); C insertion between positions 453 and 454 | S155C and S290C; and N345C and N454G; C insertion between positions 453 and 454 | 259 |
| 48 | 155 and 290 (Intra); and 374 and 454(Inter); C insertion between positions 453 and 454 | S155C and S290C; and T374C and N454G; C insertion between positions 453 and 454 | 260 |
| 49 | 155 and 290 (Intra); and 239 and 279(Inter); C insertion between positions 238 and 239 | S155C and S290C; and S238G and Q279C; C insertion between positions 238 and 239 | 261 |
| 50 | 155 and 290 (Intra); and 493 paired with C insertion between positions 329 and 330 | S155C and S290C; and S493C paired with a C insertion between positions 329 and 330 | 262 |
| 51 | 183 and 428 (Inter), G insertion between positions 182 and 183 | N183C and N428C; G insertion between positions 182 and 183 | 296 |
| 52 | 183 and 428 (Inter), C insertion between positions 427 and 428 | N183C and N427G; C insertion between positions 427 and 428 | 297 |
| 53 | 155 and 290 (Intra); and 183 and 428(Inter); G insertion between positions 182 and 183 | S155C and S290C; and N183C and N428C; G insertion between positions 182 and 183 | 298 |
| 54 | 155 and 290 (Intra); and 183 and 428(Inter); C insertion between positions 427 and 428 | S155C and S290C; and N183C and N427G; C insertion between positions 427 and 428 | 299 |

In some embodiments, the PreF antigen includes a recombinant RSV F protein including one or more (such as 2, 3, 4, 5, 6, 7, 8, 9 or 10) disulfide bonds, including disulfide bond between cysteine residues located at the RSV F positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 2 of Table 5, wherein the PreF antigen is specifically bound by a prefusion-specific antibody (e.g., D25 or AM22 antibody), and/or includes a RSV F prefusion specific conformation (such as antigenic site Ø).

In further embodiments, the PreF antigen includes a recombinant RSV F protein including one or more (such as 2, 3, 4, 5, 6, 7, 8, 9 or 10) disulfide bonds, including disulfide bonds between cysteine residues that are introduced by the cysteine amino acid substitutions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 3 of Table 5, wherein the PreF antigen is specifically bound by a prefusion-specific antibody (e.g., D25 or AM22 antibody), and/or includes a RSV F prefusion specific conformation (such as antigenic site Ø).

The SEQ ID NOs listed in column 4 of Table 5 set forth amino acid sequences including the indicated substitutions, as well as, a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

Thus, in additional embodiments, the PreF antigen includes a RSV F protein including a $F_1$ polypeptide and a $F_2$ polypeptide as set forth in any one of the SEQ ID NOs listed in column 4 of Table 5, such as a SEQ ID NO listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 4 of Table 5, wherein the PreF antigen is specifically bound by a prefusion-specific antibody (e.g., D25 or AM22 antibody), and/or includes a RSV F prefusion specific conformation (such as antigenic site Ø). For example, the PreF antigen can include a RSV F protein including a $F_1$ polypeptide and a $F_2$ polypeptide, wherein the F2 and the $F_1$ polypeptide include the amino acid sequence set forth as positions 26-109 and 137-513, respectively, of any one of the SEQ ID NOs listed in column 4 of Table 5, such as a SEQ ID NO listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 4 of Table 5, wherein the PreF antigen is specifically bound by a prefusion-specific antibody (e.g., D25 or AM22 antibody), and/or includes a RSV F prefusion specific conformation (such as antigenic site Ø).

In further embodiments, the PreF antigen includes a recombinant RSV F protein including one or more (such as 2, 3, 4, 5, 6, 7, 8, 9 or 10) intra-protomer disulfide bonds, including disulfide bond between cysteine residues located at the RSV F positions of the $F_1$ polypeptide listed in of one or more of rows 1, 2, 3, 4, 5, 6, 7, 8, 9, 10, 11, 12, 13, 14, 15, 16, 17, 18, 19, 20, or 21 of column 2 Table 5. For example, the PreF antigen can include a recombinant RSV F protein including one or more (such as 2, 3, 4, 5, 6, 7, 8, 9 or 10) intra-protomer disulfide bonds, including disulfide bonds between cysteine residues that are introduced by the $F_1$ polypeptide amino acid substitutions listed in of one or more of rows 1, 2, 3, 4, 5, 6, 7, 8, 9, 10, 11, 12, 13, 14, 15, 16, 17, 18, 19, 20, or 21 of column 3 of Table 5. In any of these embodiments, the PreF antigen is specifically bound by a prefusion-specific antibody (e.g., D25 or AM22 antibody), and/or includes a RSV F prefusion specific conformation (such as antigenic site Ø).

In further embodiments, the PreF antigen includes a recombinant RSV F protein including one or more (such as 2, 3, 4, 5, 6, or 7) intra-protomer disulfide bonds, including disulfide bond between cysteine residues located at the RSV F positions of the $F_2$ and $F_1$ polypeptides listed in of one or more of rows 22, 23, 24, 25, 26, 27, or 28 of column 2 of Table 5. For example, the PreF antigen can include a recombinant RSV F protein including one or more (such as 2, 3, 4, 5, 6, or 7) intra-protomer disulfide bonds, including disulfide bond between cysteine residues that are introduced by the $F_2$ and $F_1$ polypeptide amino acid substitutions listed in of one or more of rows 22, 23, 24, 25, 26, 27, or 28 of column 3 of Table 5. In any of these embodiments, the PreF antigen is specifically bound by a prefusion-specific antibody (e.g., D25 or AM22 antibody), and/or includes a RSV F prefusion specific conformation (such as antigenic site Ø).

In further embodiments, the PreF antigen includes a recombinant RSV F protein including one or more (such as 2, 3, 4, 5, 6, 7, 8, 9 or 10) inter-protomer disulfide bonds, including disulfide bond between cysteine residues located at the RSV F positions of the $F_1$ polypeptide listed in one or more of rows 29, 30, 31, 32, 33, 34, 35, 36, 37, 38, or 39 of column 2 of Table 5. For example, the PreF antigen can include a recombinant RSV F protein including one or more (such as 2, 3, 4, 5, 6, 7, 8, 9 or 10) inter-protomer disulfide bonds, including disulfide bond between cysteine residues that are introduced by the $F_1$ polypeptide amino acid substitutions listed in of one or more of rows 29, 30, 31, 32, 33, 34, 35, 36, 37, 38, or 39 of column 3 of Table 5. In any of these embodiments, the PreF antigen is specifically bound by a prefusion-specific antibody (e.g., D25 or AM22 antibody), and/or includes a RSV F prefusion specific conformation (such as antigenic site Ø).

In further embodiments, the PreF antigen includes a recombinant RSV F protein including an inter-protomer disulfide bond between cysteine residues located at the RSV F positions of the $F_2$ and $F_1$ polypeptides listed in column 2 of row 40 of Table 5. In further embodiments, the PreF antigen includes a recombinant RSV F protein including an inter-protomer disulfide bond between cysteine residues that are introduced by the amino acid substitutions in the $F_2$ and $F_1$ polypeptide listed in column 3 of row 40 of Table 5. In any of these embodiments, the PreF antigen is specifically bound by a prefusion-specific antibody (e.g., D25 or AM22 antibody), and/or includes a RSV F prefusion specific conformation (such as antigenic site Ø).

In some embodiments, amino acids can be inserted (or deleted) from the F protein sequence to adjust the alignment of residues in the F protein structure, such that particular residue pairs are within a sufficiently close distance to form an intra- or inter-protomer disulfide bond in the prefusion, but not postfusion, conformation. In several such embodiments, the PreF antigen includes a recombinant RSV F protein including a disulfide bond between cysteine residues located at the RSV F positions of the $F_1$ polypeptide, as well as the amino acid insertion, listed in one or more of rows 41, 42, or, 43 of column 2 of Table 5. In further embodiments, the PreF antigen includes a recombinant RSV F protein including a disulfide bond between cysteine residues that are introduced by the $F_1$ polypeptide amino acid substitutions, as well as the amino acid insertion, listed in of one or more of rows 41, 42, or, 43 of column 3 of Table 5.

In one example, the PreF antigen includes a recombinant RSV F protein stabilized in a prefusion conformation includes a disulfide bond between cysteines at F1 positions 155 and 290, such as a recombinant F1 polypeptide protein with S155C and S290C substitutions.

In some embodiments, the PreF antigen includes a recombinant RSV F protein including a combination of two or more of the disulfide bonds between cysteine residues listed in Table 5 or Table 5b, wherein the PreF antigen is specifically bound by a prefusion-specific antibody (e.g., D25 or AM22 antibody), and/or includes a RSV F prefusion specific conformation (such as antigenic site Ø). It is understood that some combinations will not result in a RSV F protein stabilized in a prefusion conformation; such combinations can be identified by methods disclosed herein, for example by confirming that the antigen containing such a polypeptide is specifically bound by a prefusion-specific antibody (e.g., D25 or AM22 antibody), and/or includes a RSV F prefusion specific conformation (such as antigenic site Ø)

In further embodiments, the PreF antigen includes a recombinant RSV F protein including a non-natural disulfide bond stabilizing the F protein in a prefusion conformation, wherein the F protein includes the substitutions listed in one of row 1, 2, 3, 4, 5, 6, 7, 8, 9, 10, 11, 12, 13, 14, 15, or 16 of column 3 of Table 5b, wherein cysteine residues are inserted in the F protein for formation of the non-natural disulfide bond. In any of these embodiments, the PreF antigen is specifically bound by a prefusion-specific antibody (e.g., D25 or AM22 antibody), and/or includes a RSV F prefusion specific conformation (such as antigenic site Ø).

The SEQ ID NOs listed in column 4 of Table 5b set forth amino acid sequences including the indicated substitutions, as well as, a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a RSV F protein including a $F_1$ polypeptide and a $F_2$ polypeptide as set forth in any one of the SEQ ID NOs listed in column 4 of Table 5b, such as a SEQ ID NO listed in one of row 1, 2, 3, 4, 5, 6, 7, 8, 9, 10, 11, 12, 13, 14, 15, or 16 of column 4 of Table 5b, wherein the PreF antigen is specifically bound by a prefusion-specific antibody (e.g., D25 or AM22 antibody), and/or includes a RSV F prefusion specific conformation (such as antigenic site Ø). For example, the PreF antigen can include a RSV F protein including a $F_1$ polypeptide and a $F_2$ polypeptide, wherein the F2 and the $F_1$ polypeptide include the amino acid sequence set forth as positions 26-109 and 137-513, respectively, of any one of the SEQ ID NOs listed in column 4 of Table 5b, such as a SEQ ID NO listed in one of row 1, 2, 3, 4, 5, 6, 7, 8, 9, 10, 11, 12, 13, 14, 15 or 16 of column 4 of Table 5b, wherein the PreF antigen is specifically bound by a prefusion-specific antibody (e.g., D25 or AM22 antibody), and/or includes a RSV F prefusion specific conformation (such as antigenic site Ø).

TABLE 5b

Exemplary stabilized F protein substitutions and sequences

| | Description | Substitutions | SEQ ID NO: |
|---|---|---|---|
| 1 | Intrachain disulfide | S238C, E92C | 421 |
| 2 | Intrachain disulfide | L193C, I59C | 422 |
| 3 | Intrachain disulfide | I59C, L297C | 423 |
| 4 | Intrachain disulfide | L297C, I292C | 424 |
| 5 | Intrachain disulfide | K176C, S190C | 425 |
| 6 | Intrachain disulfide | T189C, A177C | 426 |
| 7 | Intrachain disulfide | T58C, K191C | 427 |
| 8 | Intrachain disulfide | A424C, V450C | 428 |
| 9 | Intrachain disulfide | L171C, K191C | 429 |
| 10 | Intrachain disulfide | K176C, S190C | 430 |
| 11 | Interchain disulfide | K77C, I217C | 431 |
| 12 | Intrachain disulfide | K427C, D448C | 434 |
| 13 | Intrachain disulfide | G151C, N302C | 435 |
| 14 | Intrachain disulfide | G151C, V300C | 436 |
| 15 | Intrachain disulfide | T189C, V56C | 437 |
| 16 | Intrachain disulfide | L171C, K191C | 438 | ii. Cavity Filling Amino Acid Substitutions

Comparison of the structure of the prefusion conformation of the RSV F protein (e.g., in complex with D25 Fab as disclosed herein) to the structure of the postfusion RSV F protein (disclosed, e.g., in as disclosed in McLellan et al., *J. Virol.*, 85, 7788, 2011) identifies several internal cavities or pockets in the prefusion conformation that must collapse for F to transition to the postfusion conformation. These cavities include those listed in Table 6.

Accordingly, in several embodiments, the PreF antigen includes a recombinant RSV F protein stabilized in a prefusion conformation by one or more amino acid substitutions that introduce an amino acid that reduces the volume of an internal cavity that collapses in the postfusion conformation of RSV F protein. For example, cavities are filled by substituting amino acids with large side chains for those with small side chains. The cavities can be intra-protomer cavities, or inter-protomer cavities. One example of a RSV F cavity filling amino acid substitution to stabilize the RSV protein in its prefusion conformation a RSV F protein with S190F and V207L substitutions. In another embodiment, the cavity filling amino acid substitution to stabilize the RSV protein in its prefusion conformation a RSV F protein includes a S190F, S190L, S190W, S190H, S190M, or S190Y substitution.

The person of ordinary skill in the art can use methods provided herein to compare the structures of the pre- and post-fusion conformations of the RSV F protein to identify suitable cavities, and amino acid substitutions for filling the identified cavities. Exemplary cavities and amino acid substitutions for reducing the volume of these cavities are provided in Table 6.

TABLE 6

Exemplarity cavity-filling amino acid substitutions

| Row | Cavity/Cavities | A.A. Substitutions | SEQ ID NO: |
|---|---|---|---|
| 1 | Ser190 and Val207 | 190F and 207L | 191 |
| 2 | Val207 | 207L and 220L | 193 |
| 3 | Ser190 and Val296 | 296F and 190F | 196 |
| 4 | Ala153 and Val207 | 220L and 153W | 197 |
| 5 | Val207 | 203W | 248 |
| 6 | Ser190 and Val207 | 83W and 260W | 192 |
| 7 | Val296 | 58W and 298L | 195 |
| 8 | Val90 | 87F and 90L | 194 |
| 9 | Ser190 | 190F, 190L, 190W, 190H, 190M, or 190Y | |

The indicated cavities are referred to by a small residue abutting the cavity that can be mutated to a larger residue to fill the cavity. It will be understood that other residues (besides the one the cavity is named after) could also be mutated to fill the same cavity.

Thus, in some embodiments, the PreF antigen includes a recombinant RSV F protein including one or more amino acid substitutions that reduce the volume of one or more of the cavities listed in column 2 of Table 6, wherein the PreF antigen is specifically bound by a prefusion-specific antibody (e.g., D25 or AM22 antibody), and/or includes a RSV F prefusion specific conformation (such as antigenic site Ø). In additional embodiments, the PreF antigen includes a recombinant RSV F protein including one or more of the amino acid substitutions listed in of row 1, 2, 3, 4, 5, 6, 7, 8, or 9 of column 3 of Table 6, wherein the PreF antigen is specifically bound by a prefusion-specific antibody (e.g., D25 or AM22 antibody), and/or includes a RSV F prefusion specific conformation (such as antigenic site Ø).

The SEQ ID NOs listed in Table 6 set forth amino acid sequences including the indicated substitutions, as well as, a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a recombinant RSV F protein including a $F_1$ polypeptide and a $F_2$ polypeptide as set forth in any one of the SEQ ID NOs listed in of row 1, 2, 3, 4, 5, 6, 7 or 8 of column 4 of Table 6, wherein the PreF antigen is specifically bound by a prefusion-specific antibody (e.g., D25 or AM22 antibody), and/or includes a RSV F prefusion specific conformation (such as antigenic site Ø). For example, the PreF antigen can include a recombinant RSV F protein including a $F_1$ polypeptide and a $F_2$ polypeptide as set forth as positions 26-109 and 137-513, respectively, as set forth in any one of the SEQ ID NOs listed in of row 1, 2, 3, 4, 5, 6, 7, or 8 of column 4 of Table 6, wherein the PreF antigen is specifically bound by a prefusion-specific antibody (e.g., D25 or AM22 antibody), and/or includes a RSV F prefusion specific conformation (such as antigenic site Ø).

In additional embodiments, the PreF antigen includes a recombinant RSV F protein including the amino acid substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83 or 84 of column 3 of Table 6b, wherein the PreF antigen is specifically bound by a prefusion-specific antibody (e.g., D25 or AM22 antibody), and/or includes a RSV F prefusion specific conformation (such as antigenic site Ø).

The SEQ ID NOs listed in Table 6a set forth amino acid sequences including the indicated substitutions a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a recombinant RSV F protein including a $F_1$ polypeptide and a $F_2$ polypeptide as set forth in any one of the SEQ ID NOs listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 of column 4 of Table 6b, wherein the PreF antigen is specifically bound by a prefusion-specific antibody (e.g., D25 or AM22 antibody), and/or includes a RSV F prefusion specific conformation (such as antigenic site Ø). For example, the PreF antigen can include a recombinant RSV F protein including a $F_1$ polypeptide and a $F_2$ polypeptide as set forth as positions 26-109 and 137-513, respectively, as set forth in any one of the SEQ ID NOs listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 of column 4 of Table 6b, wherein the PreF antigen is specifically bound by a prefusion-specific antibody (e.g., D25 or AM22 antibody), and/or includes a RSV F prefusion specific conformation (such as antigenic site Ø).

TABLE 6b

Exemplarity cavity-filling amino acid substitution

| | Description | Mutations | SEQ ID NO |
|---|---|---|---|
| 1 | Cavity filling | L230F | 391 |
| 2 | Cavity filling | L158F | 392 |
| 3 | Cavity filling | L230F, L158F | 393 |
| 4 | Cavity filling | L203F | 395 |
| 5 | Cavity filling | V187F | 396 |
| 6 | Cavity filling | Y198F | 397 |
| 7 | Cavity filling | Y198W | 398 |
| 8 | Cavity filling | L204F | 399 |
| 9 | Cavity filling | Y53F, L188F | 400 |
| 10 | Cavity filling | V187F, L203F | 401 |
| 11 | Cavity filling | Y198F, L203F | 402 |
| 12 | Cavity filling | L141W | 403 |
| 13 | Cavity filling | L142F | 404 |
| 14 | Cavity filling | L142W | 405 |
| 15 | Cavity filling | V144F | 406 |
| 16 | Cavity filling | V144W | 407 |
| 17 | Cavity filling | V90F | 408 |
| 18 | Cavity filling | L83F | 409 |
| 19 | Cavity filling | V185F, T54A | 410 |
| 20 | Cavity filling | I395F | 411 |
| 21 | Cavity filling | V90F, V185F, T54A | 412 |
| 22 | Cavity filling | L83F, V90F | 413 |
| 23 | Cavity filling | L83F, V185F, T54A | 414 |
| 24 | Cavity filling | L230F, V90F, I395F | 415 |
| 25 | Cavity filling | I395F, V185F, T54A | 416 |
| 26 | Cavity filling | L203F, V90F, L230F, L158F, S509F, I395F, V185F, T54A | 417 |
| 27 | Cavity filling | I221Y | 419 |
| 28 | cavity filling | F140W | 439 |
| 29 | cavity filling | F137W | 440 |
| 30 | cavity filling | S190L, V192L | 441 |
| 31 | cavity filling | V187F, S190L, V192L | 442 |
| 32 | cavity filling | V187L, S190L, V192L | 443 |
| 33 | cavity filling | V185F V187L 8190L V192L | 444 |
| 34 | cavity filling | V154L, V157L, V185L, V187L | 445 |
| 35 | cavity filling | V154L, V185L, V187L | 446 |
| 36 | cavity filling | V187F | 447 |
| 37 | cavity filling | T58L A298L | 448 |
| 38 | cavity filling | T58L V154L V185L V187L A298L | 449 |
| 39 | cavity filling | Y458W | 450 |
| 40 | cavity filling | L158F, I167A | 451 |
| 41 | cavity filling | L158W, I167A | 452 |
| 42 | cavity filling | L158F | 453 |
| | cavity filling | L158W | 454 |
| 43 | cavity filling | V56L, I167L, A298L | 455 |
| 44 | cavity filling | V56L, I167L, A298M | 456 |
| 45 | cavity filling | V56L, A167L | 457 |
| 46 | cavity filling | I167F | 458 |
| 47 | cavity filling | I167M | 459 |
| 48 | cavity filling | V154F | 460 |
| 49 | cavity filling | V56L, I167L, A298L, V154F | 461 |
| 50 | cavity filling | I199L, L203F | 462 |
| 51 | cavity filling | I199L, L203F, P205Q, I206T | 463 |
| 52 | cavity filling | I199L, L203F, P205E, I206K | 464 |
| 53 | cavity filling | I199L, L203F, V207F | 465 |
| 54 | cavity filling | I199L, L203F, P205Q, I206T, V207F | 466 |
| 55 | cavity filling | I199L, L203F, P205E, I206K, V207F | 467 |
| 56 | cavity filling | I199L, L203F, L83F | 468 |
| 57 | cavity filling | I199L, L203F, P205Q, I206T, L83F | 469 |
| 58 | cavity filling | I199L, L203F, P205E, I206K, L83F | 470 |
| 59 | cavity filling | I199L, L203F, S190L, V192L | 471 |
| 60 | cavity filling | I199L, L203F, P205Q, I206T, V187F, S190L, V192L | 472 |
| 61 | cavity filling | S55A, S190M, L203F, V207I, V296I | 473 |
| 62 | cavity filling | Y53F, S55A, K176I, S190L, V207I, S259L, D263L, V296I | 474 |
| 63 | cavity filling | L158F, V207M, V296I | 475 |
| 64 | cavity filling | V56L, V207M, V296I | 476 |
| 65 | cavity filling | V56L, V207I, V296I | 477 |
| 66 | cavity filling | V56I, V207M, V296I | 478 |
| 67 | cavity filling | V154L, V207M, V296I | 479 |
| 68 | cavity filling | Y198F, V207I, V219W, V296I | 480 |
| 69 | cavity filling | Y198F, V207I, T219I, V296I | 481 |
| 70 | cavity filling | Y198F, V207M, T219W, V296I | 482 |
| 71 | cavity filling | Y198F, V207M, T219I, V296I | 483 |
| 72 | cavity filling | Y198F, V207M, T219L, V296I | 484 |
| 73 | Cavity filling | S190Y | 432 |
| 74 | Cavity filling | S190W | 433 |
| 75 | cavity filling | I206F, V207M, T219V, V296I | 487 |
| 76 | cavity filling | Y198F, V207M, T219L, K226M | 488 |
| 77 | cavity filling | Y198F, V207M, T219L, K226W | 489 |
| 78 | cavity filling | Y198F, V207M, T219L, K226L | 490 |
| 79 | cavity filling | L158F, L203F, V207I, V296I | 497 |
| 80 | cavity filling | F488W | 498 |
| 81 | Cavity filling | F488R | 499 |
| 82 | Cavity filling test 207L | V207L | 500 |
| 83 | Cavity filling test 207L | S190F | 501 |
| 84 | Cavity filling | S190M | 502 | iii. Repacking Substitutions

In some embodiments, the PreF antigen includes a recombinant RSV F protein stabilized in a prefusion conformation by one or more repacking amino acid substitutions. Repacking substitutions increase attractive interactions (such as hydrophobic interactions or hydrogen-bond formation), or decrease repulsive interactions (such as repulsive forces between clusters of similarly charged residues), between amino acids in a protein.

The person of ordinary skill in the art can use methods provided herein to compare the structures of the pre- and post-fusion conformations of the RSV F protein to identify suitable sites of repulsive and/or attractive interactions between RSV F protein residues, and amino acid substitutions for reducing or increasing these interactions, respectively. For example, by identifying repulsive interactions in the structure of the RSV F protein in the prefusion conformation provided herein, and introducing substitutions that reduce these repulsive interactions. Alternatively, the RSV F protein can include substitutions that increase attractive interactions between RSV F protein residues in the prefusion conformation of the RSV F protein, but not the postfusion conformation of the RSV F protein. Exemplary amino acid substitutions are provided in Table 7.

TABLE 7

Repacking Amino Acid Substitutions

| Row | Substitutions | SEQ ID NO |
|---|---|---|
| 1 | I64L, I79V, Y86W, L193V, L195F, Y198F, I199F, L203F, V207L, I214L | 227 |
| 2 | I64L, I79V, Y86W, L193V, L195F, Y198F, I199F, L203F, I214L | 228 |
| 3 | I64W, I79V, Y86W, L193V, L195F, Y198F, I199F, L203F, V207L, I214L | 229 |
| 4 | I79V, Y86F, L193V, L195F, Y198F, I199F, L203F, V207L, I214L | 230 |
| 5 | I64V, I79V, Y86W, L193V, L195F, Y198F, I199Y, L203F, V207L, I214L | 231 |
| 6 | I64F, I79V, Y86W, L193V, L195F, Y198F, I199F, L203F, V207L, I214L | 232 |
| 7 | I64L, I79V, Y86W, L193V, L195F, I199F, L203F, V207L, I214L | 233 |
| 8 | V56I, T58I, V164I, L171I, V179L, L181F, V187I, I291V, V296I, A298I | 234 |
| 9 | V56I, T58I, V164I, V179L, T189F, I291V, V296I, A298I | 235 |
| 10 | V56L, T58I, L158W, V164L, I167V, L171I, V179L, L181F, V187I, I291V, V296L | 236 |

TABLE 7-continued

Repacking Amino Acid Substitutions

| Row | Substitutions | SEQ ID NO |
|---|---|---|
| 11 | V56L, T58I, L158Y, V164L, I167V, V187I, T189F, I291V, V296L | 237 |
| 12 | V56I, T58W, V164I, I167F, L171I, V179L, L181V, V187I, I291V, V296I | 238 |
| 13 | V56I, T58I, I64L, I79V, Y86W, V164I, V179L, T189F, L193V, L195F, Y198F, I199F, L203F, V207L, I214L, I291V, V296I, A298I | 239 |
| 14 | V56I, T58I, I79V, Y86F, V164I, V179L, T189F, L193V, L195F, Y198F, I199F, L203F, V207L, I214L, I291V, V296I, A298I | 240 |
| 15 | V56I, T58W, I64L, I79V, Y86W, V164I, I167F, L171I, V179L, L181V, V187I, L193V, L195F, Y198F, I199F, L203F, V207L, I214L, I291V, V296I | 241 |
| 16 | V56I, T58W, I79V, Y86F, V164I, I167F, L171I, V179L, L181V, V187I, L193V, L195F, Y198F, I199F, L203F, V207L, I214L, I291V, V296I | 242 |
| 17 | D486N, E487Q, D489N, and S491A | 249 |
| 18 | D486H, E487Q, and D489H | 250 |
| 19 | T400V, D486L, E487L, and D489L | 251 |
| 20 | T400V, D486I, E487L, and D489I | 252 |
| 21 | T400V, S485I, D486L, E487L, D489L, Q494L, and K498L | 253 |
| 23 | T400V, S485I, D486I, E487L, D489I, Q494L, and K498L | 254 |
| 24 | K399I, T400V, S485I, D486L, E487L, D489L, Q494L, E497L, and K498L | 255 |
| 25 | K399I, T400V, S485I, D486I, E487L, D489I, Q494L, E497L, and K498L | 256 |
| 26 | L375W, Y391F, and K394M | 286 |
| 27 | L375W, Y391F, and K394W | 287 |
| 28 | L375W, Y391F, K394M, D486N, E487Q, D489N, and S491A | 288 |
| 29 | L375W, Y391F, K394M, D486H, E487Q, and D489H | 289 |
| 30 | L375W, Y391F, K394W, D486N, E487Q, D489N, and S491A | 290 |
| 31 | L375W, Y391F, K394W, D486H, E487Q, and D489H | 291 |
| 32 | L375W, Y391F, K394M, T400V, D486L, E487L, D489L, Q494L, and K498M | 292 |
| 33 | L375W, Y391F, K394M, T400V, D486I, E487L, D489I, Q494L, and K498M | 293 |
| 34 | L375W, Y391F, K394W, T400V, D486L, E487L, D489L, Q494L, and K498M | 294 |
| 35 | L375W, Y391F, K394W, T400V, D486I, E487L, D489I, Q494L, and K498M | 295 |
| 36 | F137W and R339M | 326 |
| 37 | F137W and F140W | 327 |
| 38 | F137W, F140W, and F488W | 328 |
| 39 | D486N, E487Q, D489N, S491A, and F488W | 329 |
| 40 | D486H, E487Q, D489H, and F488W | 330 |
| 41 | T400V, D486L, E487L, D489L, and F488W | 331 |
| 42 | T400V, D486I, E487L, D489I, and F488W | 332 |
| 43 | D486N, E487Q, D489N, S491A, F137W, and F140W | 333 |
| 44 | D486H, E487Q, D489H, F137W, and F140W | 334 |
| 45 | T400V, D486L, E487L, D489L, F137W, and F140W | 335 |
| 46 | L375W, Y391F, K394M, F137W, and F140W | 336 |
| 47 | L375W, Y391F, K394M, F137W, F140W, and R339M | 337 |

Thus, in some embodiments, the PreF antigen includes a recombinant RSV F protein including the amino acid substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of column 2 of Table 7, wherein the PreF antigen is specifically bound by a prefusion-specific antibody (e.g., D25 or AM22 antibody), and/or includes a RSV F prefusion specific conformation (such as antigenic site Ø).

The SEQ ID NOs listed in Table 7 set forth amino acid sequences including the indicated substitutions, as well as, a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a recombinant RSV F protein including a $F_1$ polypeptide and a $F_2$ polypeptide as set forth in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of column 3 of Table 7, wherein the PreF antigen is specifically bound by a prefusion-specific antibody (e.g., D25 or AM22 antibody), and/or includes a RSV F prefusion specific conformation (such as antigenic site Ø). For example, the PreF antigen can include a recombinant RSV F protein including a $F_1$ polypeptide and a $F_2$ polypeptide as set forth as positions 26-109 and 137-513, respectively, as set forth in any one of the SEQ ID NOs listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of column 3 of Table 7, wherein the PreF antigen is specifically bound by a prefusion-specific antibody (e.g., D25 or AM22 antibody), and/or includes a RSV F prefusion specific conformation (such as antigenic site Ø).

Several embodiments include combinations of the amino acid substitutions listed above.

iv. N-Linked Glycosylation Sites

Comparison of the structure of the prefusion conformation of the RSV F protein (e.g., in complex with D25 or AM22 as disclosed herein) to the structure of the postfusion RSV F protein (disclosed, e.g., in as disclosed in McLellan et al., *J. Virol.*, 85, 7788, 2011) identifies several regions of the RSV F protein that are solvent-accessible in the prefusion RSV F conformation described herein, but solvent-inaccessible in the postfusion RSV F conformation (as disclosed in McLellan et al., *J. Virol.*, 85, 7788, 2011).

Thus, in some embodiments, the PreF antigen includes a recombinant RSV F protein including an amino acid substitution that introduces an N-linked glycosylation site at a position that is solvent-accessible in the prefusion RSV F conformation described herein, but solvent-inaccessible in the postfusion RSV F conformation (as disclosed in McLellan et al., *J. Virol.*, 85, 7788, 2011). These amino acid substitutions stabilize the recombinant RSV F protein in the prefusion conformation by increasing the energy required for the protein to adopt the postfusion state.

To create an N-linked glycosylation site, the sequence Asn-X-Ser/Thr (where X is any amino acid except Pro) needs to be introduced. This can be accomplished by substitution of a Ser/Thr amino acid two residues C-terminal to a native Asn residue, or by substitution of an Asn amino acid two residues N-terminal to a native Ser/Thr residue, or by substitution of both an Asn and Ser/Thr residue separated by one non-proline amino acid. Thus, in several embodiments, any of the disclosed recombinant RSV F proteins are glycosylated. For example, the RSV F protein includes an amino acid substitution that introduces a N-linked glycosylation site in the RSV F protein that is solvent-accessible in the prefusion RSV F conformation disclosed herein but solvent-inaccessible in the postfusion conformation of RSV F as disclosed in McLellan et al., *J. Virol.*, 85, 7788, 2011). Exemplary N-linked glycosylation site modifications are provided in Table 8.

TABLE 8

Exemplary N-linked glycosylation

| Row | N-linked glycosylation site position | Exemplary substitutions | Exemplary SEQ ID NO |
|---|---|---|---|
| 1 | 506 | I506N and K508T | 198 |
| 2 | 175 | A177S | 199 |
| 3 | 178 | V178N | 200 |
| 4 | 276 | V278T | 203 |
| 5 | 476 | Y478T | 204 |
| 6 | 185 | V185N and V187T | 214 |
| 7 | 160 | L160N and G162S | 215 |
| 8 | 503 | L503N and a F505S | 216 |
| 9 | 157 | V157N | 217 |

In some embodiments, a PreF antigen includes a recombinant RSV F protein stabilized in a prefusion conformation by a N-linked glycosylation site at one or more of (such as 2, 3, 4, 5, 6, 7, 8, or 9 of) positions 506, 175, 178, 276, 476, 185, 160, 503, or 157 of the $F_1$ polypeptide, wherein the PreF antigen is specifically bound by a prefusion-specific antibody (e.g., D25 or AM22 antibody), and/or includes a RSV F prefusion specific conformation (such as antigenic site Ø). For example, the $F_1$ polypeptide can include an amino acid substitution that introduces an N-linked glycosylation site at one or more of (such as 2, 3, 4, 5, 6, 7, 8, or 9 of) positions 506, 175, 178, 276, 476, 185, 160, 503, or 157 of the $F_1$ polypeptide.

The SEQ ID NOs listed in Table 8 set forth amino acid sequences including the indicated substitutions, as well as, a signal peptide, $F_2$ polypeptide (positions 26-109), a pep27 polypeptide (positions 110-136), a $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). In some embodiments, the PreF antigen includes a $F_1$ polypeptide including I506N and K508T substitutions to introduce a N-linked glycosylation site at position 506. In some embodiments, the PreF antigen includes a $F_1$ polypeptide including an A177S substitution to introduce a N-linked glycosylation site at position 175. In some embodiments, the PreF antigen includes a $F_1$ polypeptide including a V178N substitution to introduce a N-linked glycosylation site at position 178. In some embodiments, the PreF antigen includes a $F_1$ polypeptide including a V278T substitution to introduce a N-linked glycosylation site at position 276. In some embodiments, the PreF antigen includes a $F_1$ polypeptide including a Y478T substitution to introduce a N-linked glycosylation site at position 476. In some embodiments, the PreF antigen includes a $F_1$ polypeptide including V185N and V187T substitutions to introduce a N-linked glycosylation site at position 185. In some embodiments, the PreF antigen includes a $F_1$ polypeptide including L160N and G162S substitutions to introduce a N-linked glycosylation site at position 160. In some embodiments, the PreF antigen includes a $F_1$ polypeptide including L503N and F505S substitutions to introduce a N-linked glycosylation site at position 503. In some embodiments, the PreF antigen includes a $F_1$ polypeptide including a V157N substitution to introduce a N-linked glycosylation site at position 157. In any of these embodiments, the PreF antigen is specifically bound by a prefusion-specific antibody (e.g., D25 or AM22 antibody), and/or includes a RSV F prefusion specific conformation (such as antigenic site Ø)

In additional embodiments, the $F_1$ polypeptide comprises residues 137-513 of SEQ ID NO: 198 (N-linked glycosylation site at position 506); SEQ ID NO: 199 (N-linked glycosylation site at position 175); SEQ ID NO: 200 (N-linked glycosylation site at position 178); SEQ ID NO: 203 (N-linked glycosylation site at position 276); SEQ ID NO: 204 (N-linked glycosylation site at position 476); SEQ ID NO: 214 (N-linked glycosylation site at position 185); SEQ ID NO: 215 (N-linked glycosylation site at position 160); SEQ ID NO: 216 (N-linked glycosylation site at position 503); or SEQ ID NO: 217 (N-linked glycosylation site at position 157), wherein the PreF antigen is specifically bound by a prefusion-specific antibody (e.g., D25 or AM22 antibody), and/or includes a RSV F prefusion specific conformation (such as antigenic site Ø).

Methods of making glycosylated polypeptides are disclosed herein and are familiar to the person of ordinary skill in the art. For example, such methods are described in U.S. Patent Application Pub. No. 2007/0224211, U.S. Pat. Nos. 7,029,872; 7,834,159, 7,807,405, Wang and Lomino, ACS Chem. Biol., 7:110-122, 2011, and Nettleship et al., Methods Mol. Biol, 498:245-263, 2009, each of which is incorporated by reference herein. In some embodiments, glycosylated PreF antigens are produced by expressing the recombinant RSV F protein in mammalian cells, such as HEK293 cells or derivatives thereof, such as GnTI$^{-/-}$ cells (ATCC® No. CRL-3022). In some embodiments, the RSV F protein antigens are produced by expression the RSV F protein antigens in mammalian cells, such as HEK293 cells or derivatives thereof, with swainsonine added to the media in order to inhibit certain aspects of the glycosylation machinery, for example to promote production of hybrid glycans.

In several embodiments, the F1 polypeptide includes two or more of the N-linked glycosylation sites listed in Table 8.

v. Exemplary Stabilizing Modifications

The person of skill in the art will appreciate that the PreF antigen can include a recombinant RSV F protein stabilized in a prefusion conformation by combinations of one or more of the stabilizing amino acid substitutions described herein, such as a combination of amino acid substitutions that introduce one or more disulfide bonds, fill cavities within the RSV F protein, alter the packing of residues in the RSV F protein, introduce N-linked glycosylation sites. For example, in several embodiments, recombinant RSV F protein includes amino acid substitutions that introduce a disulfide bond, and that fill cavities within the RSV F protein.

In some embodiments, a recombinant RSV F protein stabilized in a prefusion conformation includes a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207. For example, the cavity filling substitution at position 190 and/or position 207 can be a large aromatic or hydrophobic amino acid substitution (such as tyrosine, leucine, phenylalanine, histidine, or tryptophan).

In some embodiments, the F1 polypeptide of the recombinant RSV F protein includes S155C, S290C, and S190F amino acid substitutions. In some embodiments, the F1 polypeptide of the recombinant RSV F protein includes S155C, S290C, and S190W amino acid substitutions. In some embodiments, the F1 polypeptide of the recombinant RSV F protein includes S155C, S290C, and S190L amino acid substitutions In some embodiments, the F1 polypeptide of the recombinant RSV F protein includes S155C, S290C, S190F, and V207L amino acid substitutions. In some embodiments, the F1 polypeptide of the recombinant RSV F protein includes S155C, S290C, S190W, and V207L amino acid substitutions. In some embodiments, the F1 polypeptide of the recombinant RSV F protein includes S155C, S290C, S190L, and V207L amino acid substitutions. In some embodiments, the F1 polypeptide of the recombinant RSV F protein includes S155C, S290C, S190F, and V207F amino acid substitutions. In some embodiments, the F1 polypeptide of the recombinant RSV F protein includes S155C, S290C, S190W, and V207F amino acid substitutions. In some embodiments, the F1 polypeptide of the recombinant RSV F protein includes S155C, S290C, S190L, and V207F amino acid substitutions. In some embodiments, the F1 polypeptide of the recombinant RSV F protein includes S155C, S290C, S190F, and V207W amino acid substitutions. In some embodiments, the F1 polypeptide of the recombinant RSV F protein includes S155C, S290C, S190W, and V207W amino acid substitutions. In some embodiments, the F1 polypeptide of the recombinant RSV F protein includes S155C, S290C, S190L, and V207W amino acid substitutions.

In several embodiments, the recombinant RSV F protein stabilized in a prefusion conformation includes a F1 polypeptide and a $F_2$ polypeptide from a human RSV A subtype, a human RSV B subtype, or a bovine RSV, wherein the F1 polypeptide includes including one of the above combinations of stabilizing substitutions.

In some embodiments, the recombinant RSV F protein stabilized in a prefusion conformation includes a F2 polypeptide and a $F_1$ polypeptide including positions 26-109 and 137-513, respectively, of any one of SEQ ID NOs: 1-184 or 370, and further includes S155C, S290C, and S190F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, and S190W amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, and S190L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, and S190H amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, and S190M amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, and S190Y amino acid substitutions.

In some embodiments, the recombinant RSV F protein stabilized in a prefusion conformation includes a F2 polypeptide and a $F_1$ polypeptide including positions 26-109 and 137-513, respectively, of any one of SEQ ID NOs: 1-184 or 370, and further includes S155C, S290C, S190F, and V207L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190W, and V207L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190L, and V207L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190H, and V207L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190M, and V207L amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190Y, and V207L amino acid substitutions.

In some embodiments, the recombinant RSV F protein stabilized in a prefusion conformation includes a F2 polypeptide and a $F_1$ polypeptide including positions 26-109 and 137-513, respectively, of any one of SEQ ID NOs: 1-184 or 370, and further includes S155C, S290C, S190F, and V207F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190W, and V207F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190L, and V207F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190H, and V207F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190M, and V207F amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190Y, and V207F amino acid substitutions.

In some embodiments, the recombinant RSV F protein stabilized in a prefusion conformation includes a F2 polypeptide and a $F_1$ polypeptide including positions 26-109 and 137-513, respectively, of any one of SEQ ID NOs: 1-184 or 370, and further includes S155C, S290C, S190F, and V207W amino acid substitutions. In some embodiments, the recombinant RSV F protein stabilized in a prefusion conformation includes a $F_2$ polypeptide and a $F_1$ polypeptide including positions 26-109 and 137-513, respectively, of any one of SEQ ID NOs: 1-184 or 370, and further includes S155C, S290C, S190W, and V207W amino acid substitutions. In some embodiments, the recombinant RSV F protein stabilized in a prefusion conformation includes a F$_2$ polypeptide and a F$_1$ polypeptide including positions 26-109 and 137-513, respectively, of any one of SEQ ID NOs: 1-184 or 370, and further includes S155C, S290C, S190L, and V207W amino acid substitutions. In some embodiments, the recombinant RSV F protein stabilized in a prefusion conformation includes a F$_2$ polypeptide and a F$_1$ polypeptide including positions 26-109 and 137-513, respectively, of any one of SEQ ID NOs: 1-184 or 370, and further includes S155C, S290C, S190H, and V207W amino acid substitutions. In some embodiments, the recombinant RSV F protein stabilized in a prefusion conformation includes a F$_2$ polypeptide and a F$_1$ polypeptide including positions 26-109 and 137-513, respectively, of any one of SEQ ID NOs: 1-184 or 370, and further includes S155C, S290C, S190M, and V207W amino acid substitutions. In some embodiments, the recombinant RSV F protein stabilized in a prefusion conformation includes a F$_2$ polypeptide and a F$_1$ polypeptide including positions 26-109 and 137-513, respectively, of any one of SEQ ID NOs: 1-184 or 370, and further includes S155C, S290C, S190Y, and V207W amino acid substitutions.

In some embodiments, the recombinant RSV F protein stabilized in a prefusion conformation includes a F2 polypeptide and a F$_1$ polypeptide including positions 26-109 and 137-513, respectively, of any one of SEQ ID NOs: 1-184 or 370, and further includes S155C, S290C, S190F, V207L, and F488W amino acid substitutions. In some embodiments, the recombinant RSV F protein stabilized in a prefusion conformation includes a F$_2$ polypeptide and a F$_1$ polypeptide including positions 26-109 and 137-513, respectively, of any one of SEQ ID NOs: 1-184 or 370, and further includes S155C, S290C, S190F, and F488W amino acid substitutions.

In some embodiments, the recombinant RSV F protein stabilized in a prefusion conformation includes a F2 polypeptide and a F$_1$ polypeptide including positions 26-109 and 137-513, respectively, of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions).

In some embodiments, the PreF antigen includes a recombinant RSV F protein stabilized in a prefusion conformation that includes the amino acid substitutions listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 3 of Table 8b. The stabilized RSV F protein can be specifically bound by a prefusion-specific antibody (e.g., D25 or AM22 antibody), and/or includes a RSV F prefusion specific conformation (such as antigenic site Ø).

TABLE 8b

Exemplary recombinant RSV F protein substitutions and sequences with and without a C-terminal thrombin-cleavable Foldon domain

| | Description | Mutations | Without Foldon domain SEQ ID NO | With Thrombin-Cleavable Foldon domain SEQ ID NO |
|---|---|---|---|---|
| 1 | DSCav1 + Cavity filling + replace exposed hydrophobic residues | (S155C, S290, S190F, V207L) + L503E/I506K | 503 | 552 |
| 2 | DSCav1 + Cavity filling + replace exposed hydrophobic residues | (S155C, S290, S190F, V207L) + L503E/I506K/F505W | 504 | 553 |
| 3 | DSCav1 + Cavity filling + replace exposed hydrophobic residues | (S155C, S290, S190F, V207L) + L503E/I506K/L230F/L158F | 505 | 554 |
| 4 | DSCav1 + Cavity filling + replace exposed hydrophobic residues | (S155C, S290, S190F, V207L) + L503E/I506K/S509F/F505W/ L230F/L158F | 506 | 555 |
| 5 | DSCav1 + replace exposed hydrophobic residues | (S155C, S290, S190F, V207L) + L160K/V178T/ L258K/V384T/I431S/L467Q/ | 507 | 556 |
| 6 | DSCav1 + replace exposed hydrophobic residues | (S155C, S290, S190F, V207L) + F477K/L481Q/V482K/L503Q/I506K | 508 | 557 |
| 7 | DSCav1 + replace exposed hydrophobic residues | (S155C, S290, S190F, V207L) + L160K/V178T/ L258K/V384T/I431S/L467Q/ F477K/L481Q/V482K/L503Q/I506K | 509 | 558 |
| 8 | DSCav1 + ds | (S155C, S290, S190F, V207L) + (L512C/L513C) | 510 | 559 |
| 9 | DSCav1 + ds + replace exposed hydrophobic residues | (S155C, S290, S190F, V207L) + L160K/V178T/ L258K/V384T/I431S/L467Q/ | 511 | 560 |
| | | | 512 | 561 |

TABLE 8b-continued

Exemplary recombinant RSV F protein substitutions and sequences with
and without a C-terminal thrombin-cleavable Foldon domain

| | Description | Mutations | Without Foldon domain SEQ ID NO | With Thrombin-Cleavable Foldon domain SEQ ID NO |
|---|---|---|---|---|
| 10 | DSCav1 + ds + replace exposed hydrophobic residues | (S155C, S290, S190F, V207L) + (L512C/L513C) + F477K/L481Q/V482K/L503Q/I506K | | |
| 11 | DSCav1 + ds + replace exposed hydrophobic residues | (S155C, S290, S190F, V207L) + (L512C/L513C) + L160K/V178T/ L258K/V384T/I431S/L467Q/ F477K/L481Q/V482K/L503Q/I506K | 513 | 562 |
| 12 | DSCav1 + cavity filling | (S155C, S290, S190F, V207L) + F505W | 514 | 563 |
| 13 | DSCav1 + cavity filling + replace exposed hydrophobic residues | (S155C, S290, S190F, V207L) + F505W + L160K/V178T/ L258K/V384T/I431S/L467Q/ | 515 | 564 |
| 14 | DSCav1 + cavity filling + replace exposed hydrophobic residues | (S155C, S290, S190F, V207L) + F505W + F477K/L481Q/V482K/L503Q/I506K | 516 | 565 |
| 15 | DSCav1 + cavity filling + replace exposed hydrophobic residues | (S155C, S290, S190F, V207L) + F505W + L160K/V178T/ L258K/V384T/I431S/L467Q/ F477K/L481Q/V482K/L503Q/I506K | 517 | 566 |
| 16 | DSCav1 + ds + cavity filling | (S155C, S290, S190F, V207L) + L512C/L513C + F505W | 518 | 567 |
| 17 | DSCav1 + ds + cavity filling + replace exposed hydrophobic residues | (S155C, S290, S190F, V207L) + L512C/L513C + F505W + L160K/V178T/ L258K/V384T/I431S/L467Q/ | 519 | 568 |
| 18 | DSCav1 + ds + cavity filling + replace exposed hydrophobic residues | (S155C, S290, S190F, V207L) + L512C/L513C + F505W + F477K/L481Q/V482K/L503Q/I506K | 520 | 569 |
| 19 | DSCav1 + ds + cavity filling + replace exposed hydrophobic residues | (S155C, S290, S190F, V207L) + L512C/L513C + F505W + L160K/V178T/ L258K/V384T/I431S/L467Q/ F477K/L481Q/V482K/L503Q/I506K | 521 | 570 |
| 20 | DSCav1 + Cavity filling + replace exposed hydrophobic residues | (S155C, S290, S190F, V207L) + I506K/S509F/L83F/V90F | 522 | 571 |
| 21 | DSCav1 + Cavity filling + replace exposed hydrophobic residues | (S155C, S290, S190F, V207L) + I506K/S509F/L83F/V90F/L230F/L158F | 523 | 572 |
| 22 | DSCav1 + Cavity filling + replace exposed hydrophobic residues | (S155C, S290, S190F, V207L) + I506K/S509F/F505W/ L83F/V90F/L230FN I85F/T54A | 524 | 573 |
| 23 | DSCav1 + Cavity filling | (S155C, S290, S190F, V207L) + L83F/V90F/L230F/I395F | 525 | 574 |
| 24 | DSCav1 + Cavity filling + replace exposed hydrophobic residues | (S155C, S290, S190F, V207L) + I506K/S509F/F505W/ L83F/V90F/L230F/L158F/ I395F/V185F/T54A | 526 | 575 |
| 25 | DS + S190F + Disulfide stabilization of C-term plus more mutations | S190F, S155C, S290C, F488W, L513C, A514E, I515C | 527 | 576 |
| 26 | DS + S190F + F488W + Disulfide stabilization of C-term plus more mutations | S190F, S155C, S290C, F488W, L513C, A514E, G515E, 516C | 528 | 577 |
| 27 | DS + S190F + F488W + Disulfide stabilization of C-term plus more mutations | S190F, S155C, S290C, F488W, L512C, L513E, A514C | 529 | 578 |
| 28 | DS + S190F + F488W + Disulfide stabilization of C-term plus more mutations | S190F, S155C, S290C, F488W, L512C, L513E, A514E, G515C | 530 | 579 |

TABLE 8b-continued

Exemplary recombinant RSV F protein substitutions and sequences with and without a C-terminal thrombin-cleavable Foldon domain

| | Description | Mutations | Without Foldon domain SEQ ID NO | With Thrombin-Cleavable Foldon domain SEQ ID NO |
|---|---|---|---|---|
| 29 | DS + S190F + F488W + Disulfide stabilization of C-term plus more mutations plus 2 extra intrachain disulfides | S190F, S155C, S290C, A424C, V450C, L171C, K191C, F488W, L513C, A514E, I515C | 531 | 580 |
| 30 | DS + S190F + F488W + Disulfide stabilization of C-term plus more mutations plus 2 extra intrachain disulfides | S190F, S155C, S290C, A424C, V450C, L171C, K191C, F488W, L513C, A514E, G515E, 516C | 532 | 581 |
| 31 | DS + S190F + F488W + Disulfide stabilization of C-term plus more mutations plus 2 extra intrachain disulfides | S190F, S155C, S290C, A424C, V450C, L171C, K191C, F488W, L512C, L513E, A514C | 533 | 582 |
| 32 | DS + S190F + F488W + Disulfide stabilization of C-term plus more mutations plus 2 extra intrachain disulfides | S190F, S155C, S290C, A424C, V450C, L171C, K191C, F488W, L512C, L513E, A514E, G515C | 534 | 583 |
| 33 | DS + S190F + F488W + Disulfide stabilization of C-term plus more mutations plus 2 extra intrachain disulfide and 1 extra interchain disulfide | K77C, I217C, S190F, S155C, S290C, A424C, V450C, L171C, K191C, F488W, L513C, L514E, A515C | 535 | 584 |
| 34 | DS + S190F + F488W + Disulfide stabilization of C-term plus more mutations plus 2 extra intrachain disulfide and 1 extra interchain disulfide | K77C, I217C, S190F, S155C, S290C, A424C, V450C, L171C, K191C, F488W, L513C, L514E, A515E, G516C | 536 | 585 |
| 35 | DS + S190F + F488W + Disulfide stabilization of C-term plus more mutations plus 2 extra intrachain disulfide and 1 extra interchain disulfide | K77C, I217C, S190F, S155C, S290C, A424C, V450C, L171C, K191C, F488W, L512C, L513E, A514C | 537 | 586 |
| 36 | DS + S190F + F488W + Disulfide stabilization of C-term plus more mutations plus 2 extra intrachain disulfide and 1 extra interchain disulfide | K77C, I217C, S190F, S155C, S290C, A424C, V450C, L171C, K191C, F488W, L512C, L513E, A514E, G515C | 538 | 587 |
| 37 | DS + C-term stabilization cysteine ring | (S155C, S290C) + L513C, 514E, 515C | 539 | 588 |
| 38 | DS + C-term stabilization cysteine ring | (S155C, S290C) + L513C, 514E, 515E, 516C | 540 | 589 |
| 39 | DS + C-term stabilization cysteine ring | (S155C, S290C) + L512C, 513E, 514C | 541 | 590 |
| 40 | DS + C-term stabilization cysteine ring | (S155C, S290C) + L512C, 513E, 514E, 515C | 542 | 591 |
| 41 | DSCav1 + 512/513ds + end at residue | (S155C, S290C, S190F, V207L) + (L512C/L513C) | 543 | 592 |
| 42 | DSCav1 + end at residue 492 | (S155C, S290C, S190F, V207L) + 486DEF to CPC | 544 | 593 |
| 43 | DSCav1 | (S155C, S290C, S190F, V207L) | | 601 |
| 44 | DSCav1 with C-terminal cavity filling mutations | S155C, S290C, S190F, V207L + L512F | 672 | 683 |
| 45 | DSCav1 with C-terminal cavity filling mutations | S155C, S290C, S190F, V207L + L513F | 673 | 684 |
| 46 | DSCav1 with C-terminal cavity filling mutations | S155C, S290C, S190F, V207L + L512F, L513F | 674 | 685 |
| 47 | DSCav1 with C-terminal cavity filling mutations | S155C, S290C, S190F, V207L + L512Y, L513Y | 675 | 686 |

TABLE 8b-continued

Exemplary recombinant RSV F protein substitutions and sequences with and without a C-terminal thrombin-cleavable Foldon domain

| Description | Mutations | Without Foldon domain SEQ ID NO | With Thrombin-Cleavable Foldon domain SEQ ID NO |
|---|---|---|---|
| 48 DSCav1 with C-terminal cavity filling mutations | S155C, S290C, S190F, V207L + L512F, L513Y | 676 | 687 |
| 49 DSCav1 with C-terminal cavity filling mutations | S155C, S290C, S190F, V207L + L512W, L513W | 677 | 688 |
| 50 DSCav1 with C-terminal cavity filling mutations | S155C, S290C, S190F, V207L + L5132W, L513Y | 678 | 689 |
| 51 DSCav1 with C-terminal cavity filling mutations | S155C, S290C, S190F, V207L + S509W | 679 | 690 |
| 52 DSCav1 with C-terminal cavity filling mutations | S155C, S290C, S190F, V207L + S509F | 680 | 691 |
| 53 DSCav1 with C-terminal cavity filling mutations | S155C, S290C, S190F, V207L + S509W, L512F | 681 | 692 |
| 54 DSCav1 with C-terminal cavity filling mutations | S155C, S290C, S190F, V207L + S509W, L512F, L513F | 682 | 693 |

The SEQ ID NOs listed in Table 8b set forth amino acid sequences including the indicated substitutions, a signal peptide, $F_2$ polypeptide (positions 26-109), a pep27 polypeptide (positions 110-136), a $F_1$ polypeptide (positions 137-513), and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))) or a thrombin cleavage site (LVPRGS (positions 547-552 of SEQ ID NO: 185)), a trimerization domain (a Foldon domain), and purification tags (his-tag (HHHHHH (positions 553-558 of SEQ ID NO: 185)) and Strep Tag II (SAWSHPQFEK (positions 559-568 of SEQ ID NO: 185))). Thus, in some embodiments, the PreF antigen includes a recombinant RSV F protein including a $F_1$ polypeptide (e.g., approx. positions 137-513) and a $F_2$ polypeptide (e.g., approx. positions 26-109) as set forth in the SEQ ID NO of one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 59, 50, 51, 52, 53, or 54 of column 4 (without Foldon domain) or column 5 (with cleavable Foldon domain) of Table 8b.

In some embodiments, the PreF antigen includes a recombinant RSV F protein stabilized in a prefusion conformation that includes the amino acid substitutions listed in one of rows 1, 2, 3, 4, 5, 6, 7, 8, 9, 10, 11, 12, or 13, of column 3 of Table 8c. The stabilized RSV F protein can be specifically bound by a prefusion-specific antibody (e.g., D25 or AM22 antibody), and/or includes a RSV F prefusion specific conformation (such as antigenic site Ø).

The SEQ ID NOs listed in Table 8c set forth amino acid sequences including the indicated substitutions, a signal peptide, $F_2$ polypeptide (positions 26-109), a pep27 polypeptide (positions 110-136), a $F_1$ polypeptide (positions 137-513), a thrombin cleavage site (LVPRGS (positions 547-552 of SEQ ID NO: 185)), and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a recombinant RSV F protein including a $F_1$ polypeptide (e.g., approx. positions 137-513) and a $F_2$ polypeptide (e.g., approx. positions 26-109) as set forth in the SEQ ID NO of one of rows 1, 2, 3, 4, 5, 6, 7, 8, 9, 10, 11, 12, or 13 of column 4 of Table 8c.

TABLE 8c

Exemplary recombinant RSV F protein substitutions and sequences

| Description | Substitutions | SEQ ID NO |
|---|---|---|
| 1 Cavity filling + replace exposed hydrophobic residues | L503E/I506K/S509F | 389 |
| 2 Cavity filling + replace exposed hydrophobic residues | L503E/I506K/S509F/F505W | 390 |
| 3 Cavity filling + replace exposed hydrophobic residues | L503E/I506K/S509F/L230F/L158F | 394 |
| 4 Interchain disulfide | Q279C, S238C | 418 |
| 5 Cavity filling/hydrophobic patch | Q501F | 420 |
| 6 cavity filling + replace hydrophilic | E82V/V207M/N227L/V296I | 485 |
| 7 cavity filling + replace hydrophilic | E82V/V207I/N227L/V296I | 486 |
| 8 cavity filling + prevent helix formation | L158F/Y198F/V207M/S215G/N216P/T219L | 491 |
| 9 cavity filling + prevent helix formation | L158F/Y198F/V207M/S213G/S215G/T219L | 492 |
| 10 cavity filling + replace hydrophilic | V56L/E82V/L203F/V207M/N227L/L230F/V296I | 493 |
| 11 cavity filling + replace hydrophilic | E82V/L158F/L203F/V207M/N227L/L230F/V296I | 494 |

TABLE 8c-continued

Exemplary recombinant RSV F protein substitutions and sequences

| Description | Substitutions | SEQ ID NO |
|---|---|---|
| 12 cavity filling + replace hydrophilic | E82V/L203F/V207M/K226M/ N227L/L230F/V296I | 495 |
| 13 Disulfide + cavity filling | L203F/V207I/S180C/ S186C/V296I | 496 | b. Membrane Proximal Stabilizing Modifications

In several embodiments, the PreF antigen includes a membrane anchored form of the recombinant RSV F protein (e.g., with a transmembrane domain). In other embodiments, the PreF antigen includes a soluble form of the recombinant RSV F protein (e.g., without a transmembrane domain or other membrane anchor). It will be understood that there are several different approaches for generating a soluble or membrane anchored recombinant RSV F protein, including those discussed below. Examples include introduction of a trimerization domain, introduction of cysteine pairs that can form a disulfide bond that stabilizes the C-terminal region of $F_1$, and introduction of a transmembrane domain (e.g., for applications including a membrane-anchored PreF antigen).

Further, as disclosed herein, the structure of the RSV F protein in complex with D25 Fab (i.e., in a prefusion conformation) compared to the structure of the postfusion RSV F protein (disclosed, e.g., in McLellan et al., *J. Virol.*, 85, 7788, 2011, with coordinates deposited as PDB Accession No. 3RRR) show structural rearrangements between pre- and post-fusion conformations in both the membrane-proximal and membrane-distal lobes. Several embodiments include a modification targeted for stabilization of the membrane proximal lobe of the RSV F protein prefusion conformation. It will be understood that these modifications are not strictly necessary to stabilize a recombinant RSV F protein in a prefusion conformation, but that, in some instances, they are combined with other prefusion stabilizing modifications, such as those described above.

i. Trimerization Domain

In several embodiments, the PreF antigen is linked to a trimerization domain, for example the PreF antigen can include a recombinant RSV F protein including an F1 polypeptide with a trimerization domain linked to its C-terminus. In some embodiments, the trimerization domain promotes trimerization of the three F1/F2 monomers in the recombinant RSV F protein. Several exogenous multimerization domains promote stable trimers of soluble recombinant proteins: the GCN4 leucine zipper (Harbury et al. 1993 *Science* 262:1401-1407), the trimerization motif from the lung surfactant protein (Hoppe et al. 1994 *FEBS Lett* 344:191-195), collagen (McAlinden et al. 2003 *J Biol Chem* 278:42200-42207), and the phage T4 fibritin Foldon (Miroshnikov et al. 1998 *Protein Eng* 11:329-414), any of which can be linked to the F1 polypeptide in the PreF antigen to promote trimerization of the recombinant F protein, as long as the PreF antigen is specifically bound by a prefusion-specific antibody (e.g., D25 or AM22 antibody), and/or includes a RSV F prefusion specific conformation (such as antigenic site Ø).

In some examples, the PreF antigen can be linked to a GCN4 leucine zipper domain, for example the PreF antigen can include a recombinant RSV F protein including an F1 polypeptide with a GCN4 leucine zipper domain linked to its C-terminus. In specific examples, GCN4 leucine zipper domain is provided in the CSGJ series of constructs described herein.

In some examples, the PreF antigen can be linked to a Foldon domain, for example, the PreF antigen can include a recombinant RSV F protein including an F1 polypeptide with a Foldon domain linked to its C-terminus. In specific examples, the Foldon domain is a T4 fibritin Foldon domain such as the amino acid sequence GYIPEAPRDGQAY-VRKDGEWVLLSTF (SEQ ID NO: 351), which adopts a β-propeller conformation, and can fold and trimerize in an autonomous way (Tao et al. 1997 *Structure* 5:789-798).

In some specific examples, the PreF antigen includes a recombinant RSV F protein linked to a T4 fibritin Foldon domain, includes a $F_2$ polypeptide and an $F_1$ polypeptide linked to a Foldon domain as set forth in one of SEQ ID NOs: 185, 189-303, or 371-376. Typically, the heterologous multimerization motif is positioned C-terminal to the $F_1$ domain. Optionally, the multimerization domain is connected to the $F_1$ polypeptide via a linker, such as an amino acid linker, such as the sequence GG. The linker can also be a longer linker (for example, including the sequence GG, such as the amino acid sequence: GGSGGSGGS; SEQ ID NO: 352). Numerous conformationally neutral linkers are known in the art that can be used in this context without disrupting the conformation of the PreF antigen. Some embodiments include a protease cleavage site for removing the Foldon domain from the F1 polypeptide, such as, but not limited to, a thrombin site between the F1 polypeptide and the Foldon domain.

In some embodiments, the PreF antigen includes a recombinant RSV F protein including any of the trimerization domain modifications listed above combined with any of the modifications listed in section II.B.1.a. For example, in some embodiments, the PreF antigen includes a recombinant RSV F protein including any of the trimerization domain modifications listed above in combination with one or more of the disulfide bond modification listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or 51 of Table 5, and/or one or more of the cavity filling modifications listed in one of rows 1, 2, 3, 4, 5, 6, 7, or 8 of Table 6, and/or one or more of the repacking modifications listed in one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of Table 7, and/or one or more of the glycosylation modifications listed in one or rows 1, 2, 3, 4, 5, 6, 7, 8, or 9 of Table 8, wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein including any of the trimerization domain modifications listed above linked to an F1 polypeptide including a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the PreF antigen includes a recombinant RSV F protein including any of the trimerization domain modifications listed above linked to an F1 polypeptide including S155C, S290C, and S190F amino acid substitutions, S155C, S290C, and S190W amino acid substitutions, or S155C, S290C, and S190L amino acid substitutions. In further embodiments, the PreF antigen includes a recombinant RSV F protein including any of the trimerization domain modifications listed above linked to an F1 polypeptide including S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

For example, in some embodiments, the PreF antigen includes a recombinant RSV F protein stabilized in a RSV F protein prefusion conformation, wherein the $F_2$ polypeptide and the $F_1$ polypeptide linked to the foldon domain include the amino acid sequence set forth as positions 26-109 and 137-544, respectively, of any one of SEQ ID NO: 185, SEQ ID NO: 189, SEQ ID NO: 201, SEQ ID NO: 202, SEQ ID NO: 205, SEQ ID NO: 207, SEQ ID NO: 209, SEQ ID NO: 213, SEQ ID NO: 244, SEQ ID NO: 245, SEQ ID NO: 247, SEQ ID NO: 257, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 277, SEQ ID NO: 278, SEQ ID NO: 279, SEQ ID NO: 280, SEQ ID NO: 281, SEQ ID NO: 282, SEQ ID NO: 284, SEQ ID NO: 302, SEQ ID NO: 303, SEQ ID NO: 190, SEQ ID NO: 211, SEQ ID NO: 212, SEQ ID NO: 243, SEQ ID NO: 246, SEQ ID NO: 276, SEQ ID NO: 283, SEQ ID NO: 285, or SEQ ID NO: 263; or positions 26-109 and 137-545, respectively, of any one of SEQ ID NO: 258, SEQ ID NO: 259, SEQ ID NO: 260, SEQ ID NO: 261, SEQ ID NO: 262, SEQ ID NO: 296, SEQ ID NO: 297, SEQ ID NO: 298, or SEQ ID NO: 299, wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein stabilized in a RSV F protein prefusion conformation, wherein the $F_2$ polypeptide and the $F_1$ polypeptide linked to the foldon domain include the amino acid sequence set forth as positions 26-109 and 137-544, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions), wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein including a $F_1$ polypeptide and a $F_2$ polypeptide from a human RSV A subtype, a human RSV B subtype, or a bovine RSV, wherein the F1 polypeptide is linked to any of the trimerization domain modifications listed above, and the F1 polypeptide further includes any of the stabilizing modifications described herein (e.g., any of the above combinations of stabilizing substitutions such as S155C, S290C, and S190F substitutions, or S155C, S290C, S190F, and V207L substitutions).

In some embodiments, the PreF antigen includes a recombinant RSV F protein stabilized in a RSV F protein prefusion conformation, and includes one or more cavity-filling amino acid substitution and a Foldon domain, wherein the $F_2$ polypeptide and the $F_1$ polypeptide linked to the Foldon domain include the amino acid sequence set forth as positions 26-109 and 137-544, respectively, of any one of SEQ ID NO: 191, SEQ ID NO: 193, SEQ ID NO: 196, SEQ ID NO: 197, SEQ ID NO: 248, SEQ ID NO: 192, SEQ ID NO: 195, or SEQ ID NO: 194; wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein stabilized in a RSV F protein prefusion conformation, and includes one or more repacking amino acid substitutions and a foldon domain, wherein the $F_2$ polypeptide and the $F_1$ polypeptide linked to the foldon domain include the amino acid sequence set forth as positions 26-109 and 137-544, respectively, of any one of SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, or SEQ ID NO: 337; wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein stabilized in a RSV F protein prefusion conformation, and includes one or more N-linked glycosylation sites and a Foldon domain, wherein the $F_2$ polypeptide and the $F_1$ polypeptide linked to the Foldon domain include the amino acid sequence set forth as positions 26-109 and 137-544, respectively, of any one of SEQ ID NOs selected from the group consisting of SEQ ID NO: 198, SEQ ID NO: 199, SEQ ID NO: 200, SEQ ID NO: 203, SEQ ID NO: 204, SEQ ID NO: 214, SEQ ID NO: 215, SEQ ID NO: 216, or SEQ ID NO: 217; wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein including the amino acid substitutions listed in one of row 1, 2, 3, 4, 5, 6, 7, 8, 9, 10, 11, 12, 13, 14, 15, or 16 of column 3 of Table 5b, wherein the F1 polypeptide of the recombinant RSV F protein is linked to a Foldon domain. Some embodiments include a protease cleavage site for removing the Foldon domain from the F1 polypeptide, for example a thrombin cleavage site.

In some embodiments, the PreF antigen includes a recombinant RSV F protein stabilized in a RSV F protein prefusion conformation, including a $F_2$ polypeptide and a $F_1$ polypeptide linked to a Foldon domain, wherein the F2 polypeptide and the $F_1$ polypeptide linked to the Foldon domain include the amino acid sequence set forth as positions 26-109 and 137-544, respectively, of one of the SEQ ID NOs listed in one of row 1, 2, 3, 4, 5, 6, 7, 8, 9, 10, 11, 12, 13, 14, 15, or 16 of column 4 of Table 5b, In several embodiments, the $F_1$ polypeptide linked to the Foldon domain further includes a protease cleavage site, such as, but not limited to, a thrombin site, between the F1 polypeptide and the Foldon domain.

In some embodiments, the PreF antigen includes a recombinant RSV F protein including the amino acid substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 of column 3 of Table 6b, wherein the F1 polypeptide of the recombinant RSV F protein is linked to a Foldon domain.

In some embodiments, the PreF antigen includes a recombinant RSV F protein stabilized in a RSV F protein prefusion conformation, including a $F_2$ polypeptide and a $F_1$ polypeptide linked to a Foldon domain, wherein the F2 polypeptide and the $F_1$ polypeptide linked to the Foldon domain include the amino acid sequence set forth as positions 26-109 and 137-544, respectively, of one of the SEQ ID NOs listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 of column 4 of Table 6b.

In further embodiments, the PreF antigen includes a recombinant RSV F protein stabilized in a RSV F protein prefusion conformation, wherein the recombinant RSV F protein includes the amino acid substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 59, 50, 51, 52, 53, or 54 of column 3 of Table 8b, wherein the F1 polypeptide of the recombinant RSV F protein is linked to a Foldon domain. In some embodiments, the PreF antigen includes a recombinant RSV F protein stabilized in a RSV F protein prefusion conformation, including a $F_2$ polypeptide and a $F_1$ polypeptide linked to a Foldon domain, wherein the $F_2$ polypeptide and the $F_1$ polypeptide linked to the Foldon domain include the amino acid sequence set forth as positions 26-109 and 137-544, respectively, of one of the SEQ ID NOs listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 of column 5 of Table 8b. These sequences include a thrombin cleavage site between the F1 polypeptide and the Foldon domain.

In further embodiments, the PreF antigen includes a recombinant RSV F protein stabilized in a RSV F protein prefusion conformation, wherein the recombinant RSV F protein includes the amino acid substitutions listed in row 1, 2, 3, 4, 5, 6, 7, 8, 9, 10, 11, 12, or 13 of column 3 of Table 8c, wherein the F1 polypeptide of the recombinant RSV F protein is linked to a Foldon domain. In some embodiments, the PreF antigen includes a recombinant RSV F protein stabilized in a RSV F protein prefusion conformation, including a $F_2$ polypeptide and a $F_1$ polypeptide linked to a Foldon domain, wherein the $F_2$ polypeptide and the F1 polypeptide linked to the Foldon domain include the amino acid sequence set forth as positions 26-109 and 137-544, respectively, of the SEQ ID NO listed in row 1, 2, 3, 4, 5, 6, 7, 8, 9, 10, 11, 12, or 13 of column 4 of Table 8c.

Modified Foldon domains can also be used, such as a Foldon domain including an amino acid sequence set forth as GYIPEAPRDGQCYVRCDGEWVLLSTF (SEQ ID NO: 694), GYIPECPRDGQAYVCKDGEWVLLSTF (SEQ ID NO: 695), GYIPEAPRDGQCYCRKDGEWVELSTF (SEQ ID NO: 696), or GYIPEAPRDGQACVRKDGECVLLSTF (SEQ ID NO: 697). These modified Foldon domains include amino acid substitutions that add two cysteine residues for formation of stabilizing disulfide bonds. Exemplary RSV F protein sequences including the DSCav1 amino acid substitutions linked to the modified Foldon domains include those set forth as SEQ ID NO: 651, SEQ ID NO: 652, SEQ ID NO: 653, and SEQ ID NO: 654. In some embodiments, any of the disclosed recombinant RSV F proteins can be linked to a modified Foldon domain as described herein.

ii. Disulfide Bonds

In some embodiments, the PreF antigen includes a recombinant RSV F protein including a F1 polypeptide including one or more disulfide bonds that are used to stabilize the membrane proximal lobe of the recombinant RSV F protein. The cysteine residues that form the disulfide bond can be introduced into the recombinant RSV F protein by one or more amino acid substitutions.

The location of the cysteine (or cysteines) of a disulfide bond to stabilize the membrane proximal lobe of the RSV F protein in a prefusion conformation can readily be determined by the person of ordinary skill in the art using methods described herein and familiar to the skilled artisan. In some embodiments, a ring of disulfide bonds is introduced into the C-terminus of the F1 polypeptide by substituting cysteine residues for amino acids of the α10 helix. The three α10 helixes of the RSV F Ectodomain for a coil-coil that stabilized the membrane proximal portion of the protein. When expressed in cells, inter-protomer disulfide bonds form between the cysteines introduced into the α10 helix, thereby "locking" the three α10 helix's in close proximity and preventing movement of the membrane proximal domain from the pre- to the post-fusion conformation. The α10 helix of the RSV F protein includes residues 492 to the transmembrane domain (residue 529).

In some embodiments, the PreF antigen includes a recombinant RSV F protein including a disulfide bond between cysteine residues located at RSV F positions 486 and 487, or between cysteine residues located at RSV F positions 512 and 513, wherein the PreF antigen is specifically bound by a prefusion-specific antibody (e.g., D25 or AM22 antibody), and/or includes a RSV F prefusion specific conformation (such as antigenic site Ø). In some such embodiments, the $F_1$ polypeptide includes D486C and E487C substitutions, L512C and L513C substitutions, or D486C, E487C, L512C, and L513C substitutions respectively.

In some embodiments, amino acids can be inserted (or deleted) from the F protein sequence to adjust the alignment of residues in the F protein structure, such that particular residue pairs are within a sufficiently close distance to form an disulfide bond. In some such embodiments, the PreF antigen includes a recombinant RSV F protein including a disulfide bond between cysteine residues located at 486 and 487; with a proline insertion between positions 486 and 487, wherein the PreF antigen is specifically bound by a prefusion-specific antibody (e.g., D25 or AM22 antibody), and/or includes a RSV F prefusion specific conformation (such as antigenic site Ø). In some such embodiments, the $F_1$ polypeptide includes D486C and E487C substitutions, and a proline insertion between positions 486 and 487.

In additional embodiments, the PreF antigen includes a recombinant RSV F protein including a disulfide bond between a cysteine residue located at position 493 and a cysteine residue inserted between positions 329 and 330, wherein the PreF antigen is specifically bound by a prefusion-specific antibody (e.g., D25 or AM22 antibody), and/or includes a RSV F prefusion specific conformation (such as antigenic site Ø). In some such embodiments, the $F_1$ polypeptide includes S493C substitution, and a cysteine residue inserted between positions 329 and 330.

In additional embodiments, the PreF antigen includes a recombinant RSV F protein including a disulfide bond between a cysteine residue located at position 493 and a cysteine residue inserted between positions 329 and 330, and further includes a glycine insertion between residues 492 and 493, wherein the PreF antigen is specifically bound by a prefusion-specific antibody (e.g., D25 or AM22 antibody), and/or includes a RSV F prefusion specific conformation (such as antigenic site Ø). In some such embodiments, the $F_1$ polypeptide includes S493C substitution, a cysteine residue inserted between positions 329 and 330, and a glycine insertion between residues 492 and 493

In additional embodiments, the recombinant RSV F protein includes cysteine substitutions in the α10 helix at positions 525 and 526, 512 and 513, and/or 519 and 520, which can form interprotomer disulfide bonds to stabilize the C-terminal region of the F1 polypeptide. For example, in some embodiments, the recombinant RSV F protein includes any of the "motifs" listed in Table 23. In additional embodiments, the recombinant RSV F protein includes an amino acid sequence at least 80% (such as at least 90%, at least 95% or at least 98% identical) to the amino acid sequence set forth as any one of SEQ ID NOs: 829-1025 or 1456-1468, optionally without including the purification tags or trimerization domains included in these sequences.

In some embodiments, the recombinant RSV F protein includes, extending C-terminal from position 512, the amino acid sequence set forth as one of CCHNVNAGKSTTN (residues 512-524 of SEQ ID NO: 844) or CCHNVNACCSTTN (residues 512-524 of SEQ ID NO: 853); or CCHNVNACCSTTNICCTT (residues 512-529 of SEQ ID NO: 853).

In some embodiments, the PreF antigen includes a recombinant RSV F protein including any of the above disulfide bond modifications for stabilizing the membrane proximal lobe of the RSV F protein, combined with any of the stabilization modifications listed in section II.B.1.a. In some embodiments, the PreF antigen includes a recombinant RSV F protein including any of the disulfide bond modifications for stabilizing the membrane proximal lobe of the RSV F protein listed above in combination with the disulfide bond substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or 51 of Table 5, or row 1, 2, 3, 4, 5, 6, 7, 8, 9, 10, 11, 12, 13, 14, 15 or 16 of Table 5b, or the cavity filling substitutions listed in one of row 1, 2, 3, 4, 5, 6, 7, or 8 of Table 6, or one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83 or 84 of column 3 of Table 6b, or the repacking substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of Table 7, or the glycosylation modifications listed in one of row 1, 2, 3, 4, 5, 6, 7, 8, or 9 of Table 8, or the substitutions listed in row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 59, 50, 51, 52, 53, or 54 of column 3 of Table 8b, or the substitutions listed in row 1, 2, 3, 4, 5, 6, 7, 8, 9, 10, 11, 12, or 13 of column 3 of Table 8c, wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein including any of the disulfide bond modifications for stabilizing the membrane proximal lobe of the RSV F protein listed above and further includes a F1 polypeptide including a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the PreF antigen includes a recombinant RSV F protein including any of the disulfide bond modifications for stabilizing the membrane proximal lobe of the RSV F protein listed above and further includes a F1 polypeptide including S155C, S290C, and S190F amino acid substitutions, S155C, S290C, and S190W amino acid substitutions, or S155C, S290C, and S190L amino acid substitutions. In further embodiments, the PreF antigen includes a recombinant RSV F protein including any of the disulfide bond modifications for stabilizing the membrane proximal lobe of the RSV F protein listed above and further includes a F1 polypeptide including S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

In some embodiments, the PreF antigen includes a recombinant RSV F protein including a $F_2$ polypeptide and a $F_1$ polypeptide including the amino acid sequence set forth as positions 26-109 and 137-513, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions), wherein the recombinant RSV F protein further includes any of the disulfide bond modifications for stabilizing the membrane proximal lobe of the RSV F protein listed above, wherein the PreF antigen is specifically bound by a prefusion-specific antibody (e.g., D25 or AM22 antibody), and/or includes a RSV F prefusion specific conformation (such as antigenic site Ø).

In several embodiments, the PreF antigen includes a recombinant RSV F protein including a $F_1$ polypeptide and a $F_2$ polypeptide from a human RSV A subtype, a human RSV B subtype, or a bovine RSV, wherein the recombinant RSV F protein further includes any of the disulfide bond modifications for stabilizing the membrane proximal lobe of the RSV F protein listed above, and wherein the F1 polypeptide further includes any of the stabilizing modifications described herein (e.g., one of the above combinations of stabilizing substitutions such as S155C, S290C, and S190F substitutions, or S155C, S290C, S190F, and V207L substitutions).

iii. Transmembrane Domains

In some embodiments, the recombinant RSV F protein includes a transmembrane domain linked to the $F_1$ polypeptide, for example, for an application including a membrane anchored PreF antigen). For example, the presence of the transmembrane sequences is useful for expression as a transmembrane protein for membrane vesicle preparation. The transmembrane domain can be linked to a $F_1$ protein containing any of the stabilizing mutations provided herein, for example, those described above, such as a $F_1$ protein with a S155C/S290C cysteine substitution. Additionally, the transmembrane domain can be further linked to a RSV $F_1$ cytosolic tail. Examples including a signal peptide, $F_2$ polypeptide (positions 26-109), pep27 polypeptide (positions 110-136), $F_1$ polypeptide (positions 137-513), a RSV transmembrane domain are provided as SEQ ID NO: 323 (without a cytosolic domain) and SEQ ID NO: 324 (with a cytosolic domain).

In some embodiments, the PreF antigen includes a recombinant RSV F protein including an F1 polypeptide linked to a transmembrane domain, combined with any of the stabilization modifications listed in section II.B.1a. For example, in some embodiments, the PreF antigen includes a recombinant RSV F protein including an F1 polypeptide linked to a transmembrane domain, and further includes the disulfide bond substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or 51 of Table 5, or row 1, 2, 3, 4, 5, 6, 7, 8, 9, 10, 11, 12, 13, 14, 15 or 16 of Table 5b, or the cavity filling substitutions listed in one of row 1, 2, 3, 4, 5, 6, 7, or 8 of Table 6, or one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83 or 84 of column 3 of Table 6b, or the repacking substitutions listed in one of row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, or 47 of Table 7, or the glycosylation modifications listed in one of row 1, 2, 3, 4, 5, 6, 7, 8, or 9 of Table 8, or the substitutions listed in row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 59, 50, 51, 52, 53, or 54 of column 3 of Table 8b, or the substitutions listed in row 1, 2, 3, 4, 5, 6, 7, 8, 9, 10, 11, 12, or 13 of column 3 of Table 8c, wherein the PreF antigen is specifically bound by a prefusion-specific antibody (e.g., D25 or AM22 antibody), and/or includes a RSV F prefusion specific conformation (such as antigenic site Ø).

In some embodiments, the PreF antigen includes a recombinant RSV F protein including an F1 polypeptide linked to a transmembrane domain, wherein the F1 polypeptide further includes a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the PreF antigen includes a recombinant RSV F protein including an F1 polypeptide linked to a transmembrane domain, wherein the F1 polypeptide further includes S155C, S290C, and S190F amino acid substitutions, S155C, S290C, and S190W amino acid substitutions, or S155C, S290C, and S190L amino acid substitutions. In further embodiments, the PreF antigen includes a recombinant RSV F protein including an F1 polypeptide linked to a transmembrane domain, wherein the F1 polypeptide further includes S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

In some embodiments, the PreF antigen includes a recombinant RSV F protein including a $F_2$ polypeptide and a F1 polypeptide linked to a transmembrane domain, wherein the $F_2$ polypeptide and the $F_1$ polypeptide linked to the transmembrane domain include the amino acid sequence set forth as positions 26-109 and 137-513, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions), wherein the PreF antigen is specifically bound by a prefusion-specific antibody (e.g., D25 or AM22 antibody), and/or includes a RSV F prefusion specific conformation (such as antigenic site Ø).

In several embodiments, the PreF antigen includes a recombinant RSV F protein including a $F_1$ polypeptide and a $F_2$ polypeptide from a human RSV A subtype, a human RSV B subtype, or a bovine RSV, wherein the $F_1$ polypeptide is linked to any of the transmembrane domains listed above, and the F1 polypeptide further includes any of the stabilizing modifications described herein (e.g., one of the above combinations of stabilizing substitutions such as S155C, S290C, and S190F substitutions, or S155C, S290C, S190F, and V207L substitutions).

iv. Cavity Filling Substitutions

In some embodiments, the PreF antigen includes a recombinant RSV F protein including a F1 polypeptide including one or more cavity filling substitutions that are used to stabilize the membrane proximal lobe of the recombinant RSV F protein. In some embodiments, the PreF antigen includes a recombinant RSV F protein including a F1 polypeptide with V207L and L512F; L513F; L512F and L513F; L512Y and L513Y; L512F and L513Y; L512W and L513W; L5132W and L513Y; S509W; S509F; S509W and L512F; or S509W, L512F and L513F substitutions, wherein the PreF antigen is specifically bound by a prefusion-specific antibody (e.g., D25 or AM22 antibody), and/or includes a RSV F prefusion specific conformation (such as antigenic site Ø). Exemplary sequences with such substitutions include SEQ ID NOs: 672-682.

c. Antigenic Sites

In some embodiments, the PreF antigen includes a recombinant RSV F protein that is stabilized in a prefusion conformation and includes further modification to eliminate a known antigenic site other than antigenic site Ø. For example, the recombinant RSV F protein can include a modification that disrupts antigenic site I, II or IV. Such modifications can be identified, for example, by binding of antibodies specific for these sites.

In some embodiments, the antigens are provided that include a recombinant RSV F protein that includes modification to eliminate antigenic site Ø. Such antigens are useful, for example, as control reagents.

Exemplary modifications for removing antigenic site Ø and/or antigenic site II are listed in Table 8c1.

TABLE 8c1

Exemplary recombinant RSV F protein substitutions and sequences

| | Description | Substitutions | SEQ ID NO |
|---|---|---|---|
| 1 | knock out site Ø binding | K65N/N67T, P205N/V207T, K209N/S211T + Avi-tag | 655 |
| 2 | knock out site II binding | Q270T + Avi-tag | 656 |
| 3 | knock out site II binding | N268R/K272E + Avitag | 657 |
| 4 | knock out site Ø binding | K65N/N67T, P205N/V207T, K209N/S211T + Avi-tag | 658 |
| 5 | knock out site II binding | Q270T + Avi-tag | 659 |
| 6 | knock out site II binding | N268R/K272E + Avitag | 660 |
| 7 | knock out site Ø and II binding | K65N/N67T, P205N/V207T, K209N/S211T, Q270T + Avi-tag | 661 |
| 8 | knock out site Ø and II binding | K65N/N67T, P205N/V207T, K209N/S211T, N268R/K272E + Avi-tag | 662 |
| 9 | knock out site Ø and II binding | K65N/N67T, P205N/V207T, K209N/S211T, Q270T + Avi-tag | 663 |
| 10 | knock out site Ø and II binding | K65N/N67T, P205N/V207T, K209N/S211T,N268R/K272E + Avi-tag | 664 | d. Single Chain RSV F Proteins

In some embodiments, the recombinant RSV F protein is a single chain RSV F protein, which includes a single polypeptide chain including the RSV $F_1$ polypeptide and the RSV $F_2$ polypeptide. The disclosed single chain RSV F proteins do not include the furin cleavage sites flanking the pep27 polypeptide of RSV F protein; therefore, when produced in cells, the F polypeptide is not cleaved into separate F1 and $F_2$ polypeptides. In several embodiments, the remaining portions of the $F_1$ and $F_2$ polypeptides are joined by a linker, such as a peptide linker.

In several embodiments, a single polypeptide chain including the F2, pep27, and $F_1$ sequences is produced. The single chain RSV F proteins can include the pep27 sequence, or this sequence can be deleted. Further, in examples wherein the pep27 sequence is deleted, a linker (such as a peptide linker) optionally can be placed between the $F_2$ and $F_1$ polypeptides in the recombinant single chain RSV F protein. In some embodiments, a single chain RSV F protein includes deletion of RSV F positions 98-149 or 106-149 which removes the two furin cleavage sites, the pep27 polypeptide, and the fusion peptide. In some embodiments, a single chain RSV F protein includes deletion of RSV F positions 98-136, 98-144, 98-149, 106-136, 104-144, or 106-144.

In several embodiments, the stabilizing mutations disclosed herein (for example, in sections (B.1.a) through (B.1.c) above can be included in the single chain RSV F protein. For example, in some embodiments, the single chain RSV F protein include S155C and S290C substitutions; S155C, S290C and S190F substitutions, or S155C, S290C, S190F, and V207L substitutions. In some embodiments, the PreF antigen includes a recombinant RSV F protein in single chain format stabilized in a prefusion conformation that includes the amino acid substitutions listed in one of rows 1, 2, 3, 4, 5, 6, or 7 of column 3 of Table 8d. The stabilized RSV F protein can be specifically bound by a prefusion-specific antibody (e.g., D25 or AM22 antibody), and/or includes a RSV F prefusion specific conformation (such as antigenic site Ø).

Exemplary sequences are listed in Table 8d. The SEQ ID NOs listed in Table 8d set forth amino acid sequences including the indicated substitutions, a signal peptide, $F_2$ polypeptide (positions 26-109), a pep27 polypeptide (positions 110-136), a $F_1$ polypeptide (positions 137-513), and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))) or a thrombin cleavage site (LVPRGS (positions 547-552 of SEQ ID NO: 185)), a trimerization domain (a Foldon domain), and purification tags (his-tag (HHHHHH (positions 553-558 of SEQ ID NO: 185)) and Strep Tag II (SAWSHPQFEK (positions 559-568 of SEQ ID NO: 185))). Thus, in additional embodiments, the PreF antigen includes a recombinant RSV F protein including a $F_1$ polypeptide (e.g., approx. positions 137-513) and a $F_2$ polypeptide (e.g., approx. positions 26-109) as set forth in the SEQ ID NO listed in one of rows 1, 2, 3, 4, 5, 6, 7, 8, 9, 10, 11, 12, 13, or 14 of column 4 (without Foldon domain) or column 5 (with cleavable Foldon domain) of Table 8d. Additional exemplary single chain RSV F protein mutations and sequences are described herein, for example as disclosed in Table 8e (e.g., rows 34-43) and Table 18.

TABLE 8d

Single chain recombinant RSV F proteins

| | Description | Mutations | Without Foldon domain SEQ ID NO | With Thrombin-Cleavable Foldon domain SEQ ID NO |
|---|---|---|---|---|
| 1 | Single chain DS | S155C, S290C | 545 | 594 |
| 2 | Single chain Cav1 | S190F, V207L | 546 | 595 |
| 3 | Single chain F488W | F488W | 547 | 596 |
| 4 | Single chain DSCav1 | (S155C, S290C, S190F, V207L) | 548 | 597 |
| 5 | Single chain DS + F488W | (S155C, S290C) + F488W | 549 | 598 |
| 6 | Single chain Cav1 + F488W | (S190F, V207L) + F488W | 550 | 599 |
| 7 | Single chain DSCav1 + F488W | (S155C, S290, S190F, V207L) + F488W | 551 | 600 |
| 8 | add cav1 to SEQ ID NO: 320 single chain | add cav1 to SEQ ID NO: 320 single chain | 665 | |
| 9 | add cav1, F488W to SEQ ID NO: 320] single chain | add cav1, F488W to SEQ ID NO: 320] single chain | 666 | |
| 10 | add cav1 to SEQ ID NO: 319 single chain | add cav1 to SEQ ID NO: 319 single chain | 667 | |
| 11 | add cav1 F488W to SEQ ID NO: 319 single chain | add cav1 F488W to SEQ ID NO: 319 single chain | 668 | |
| 12 | single chain with improved linker | 155C, S290C, S190F, V207L, GS linker between 105/145 | | 669 (not a cleavable Foldon) |
| 13 | single chain with improved linker | 155C, S290C, GS linker between residue 105 to 145 | 670 | |
| 14 | single chain with improved linker | 155C, S290C, GS linker between residue 105 to 145 | 671 | |

Sequences of additional single chain RSV f proteins that are stabilized in a prefusion confirmation are provided in Table 19, including single chain RSV F proteins with non-cleavable Foldon domains, cleavable Foldon domains, and linked to protein nanoparticle subunits.

2. Minimal Site Ø Immunogens

The site Ø epitope of RSV F is located on the apex of the trimer spike and includes the region recognized by the three neutralizing antibodies D25, AM22 and 5C4. More specifically, as delineated by the crystal structure of the RSV F/D25 complex, this epitope comprises the outer surface of helix α4 (residues 196-209) and the adjacent loop (residues 63-68) between β2 and α1. Provided herein are immunogens that include these minimal aspects of the RSV F protein and which are useful, for example, for inducing an immune response to RSV, and also for specific binding to RSV F protein antibodies, for example as probes to identify or detect such antibodies.

Accordingly, in some embodiments, the recombinant RSV F protein includes the minimal region necessary to stimulate an immune response to RSV. In some embodiments, the RSV F protein includes or consists of an amino acid sequence at least 80% identical to a sequence set forth in Table 20. In additional embodiments, the recombinant RSV F protein comprises circular permutation of antigenic site Ø as set forth in Table 20, such as set forth in SEQ ID NOs: 1027-1052.

The minimal epitope region can be linked to a scaffold protein to stabilize the epitope in an antigenic conformation. For example, any of the minimal site Ø antigen listed herein can be linked to a 2KNO, 2A90, 2W59, 3U2E, 2VJ1, 1CHD, 1PQZ, or a 2MOE scaffold protein. These are the reference identifiers for specific sequences located in the PDB database, and are incorporated by reference herein as present in the data base on Mar. 11, 2014. Specific examples of minimal site Ø antigen linked to a scaffold protein are provided herein in Table 20.

Any of the minimal site Ø antigen can be linked to a protein nanoparticle subunit, for example a ferritin subunit or a lumazine synthase subunit, to generate a protein nanoparticle. Specific examples of minimal site Ø antigens linked to a protein nanoparticle subunit are provided herein in the Table 21.

In several embodiments, the PreF antigen includes an epitope-scaffold protein including a RSV F protein prefusion specific epitope in a prefusion specific conformation. In some examples, the epitope scaffold protein includes any of the recombinant RSV F proteins stabilized in a prefusion conformation as disclosed herein. The prefusion specific epitope can be placed anywhere in the scaffold protein (for example, on the N-terminus, C-terminus, or an internal loop), as long as the PreF antigen including the epitope scaffold protein is specifically bound by a prefusion-specific antibody (e.g., D25 or AM22 antibody), and/or includes a RSV F prefusion specific conformation (such as antigenic site Ø).

Methods for identifying and selecting scaffolds are disclosed herein and known to the person of ordinary skill in the art. For example, methods for superposition, grafting and de novo design of epitope-scaffolds are disclosed in U.S. Patent Application Publication No. 2010/0068217, incorporated by reference herein in its entirety.

"Superposition" epitope-scaffolds are based on scaffold proteins having an exposed segment with similar conformation as the target epitope—the backbone atoms in this "superposition-region" can be structurally superposed onto the target epitope with minimal root mean square deviation (RMSD) of their coordinates. Suitable scaffolds are identified by computationally searching through a library of protein crystal structures; epitope-scaffolds are designed by putting the epitope residues in the superposition region and making additional mutations on the surrounding surface of the scaffold to prevent clash or other interactions with the antibody.

"Grafting" epitope-scaffolds utilize scaffold proteins that can accommodate replacement of an exposed segment with the crystallized conformation of the target epitope. For each suitable scaffold identified by computationally searching through all protein crystal structures, an exposed segment is replaced by the target epitope and the surrounding sidechains are redesigned (mutated) to accommodate and stabilize the inserted epitope. Finally, as with superposition epitope-scaffolds, mutations are made on the surface of the scaffold and outside the epitope, to prevent clash or other interactions with the antibody. Grafting scaffolds require that the replaced segment and inserted epitope have similar translation and rotation transformations between their N- and C-termini, and that the surrounding peptide backbone does not clash with the inserted epitope. One difference between grafting and superposition is that grafting attempts to mimic the epitope conformation exactly, whereas superposition allows for small structural deviations.

"De novo" epitope-scaffolds are computationally designed from scratch to optimally present the crystallized conformation of the epitope. This method is based on computational design of a novel fold (Kuhlman, B. et al. 2003 Science 302:1364-1368). The de novo allows design of immunogens that are both minimal in size, so they do not present unwanted epitopes, and also highly stable against thermal or chemical denaturation.

The scaffold can be a heterologous scaffold. In several embodiments, the native scaffold protein (without epitope insertion) is not a viral envelope protein. In additional embodiments, the scaffold protein is not a RSV protein. In still further embodiments, the scaffold protein is not a viral protein.

In additional embodiments, the epitope-scaffold protein includes the amino acid sequence set forth as any one of SEQ ID NOs: 341-343, or a polypeptide with at least 80% sequence identity (such as at least 85%, at least 90%, at least 95%, at least 96%, at least 97%, at least 98% or at least 99% sequence identity) to any one of SEQ ID NOs: 341-343, and wherein the epitope-scaffold protein is specifically bound by a prefusion-specific antibody (e.g., D25 or AM22 antibody), and/or includes a RSV F prefusion specific conformation (such as antigenic site Ø). In additional embodiments, the RSV F protein is any one of SEQ ID NOs: 341-343, wherein the amino acid sequence of the RSV F protein has up to 20 amino acid substitutions, and wherein the epitope scaffold protein is specifically bound by a prefusion-specific antibody (e.g., D25 or AM22 antibody), and/or includes a RSV F prefusion specific conformation (such as antigenic site Ø), in the absence of binding by the corresponding prefusion-specific antibody (e.g., D25 or AM22 antibody). Alternatively, the polypeptide can have none, or up to 1, 2, 3, 4, 5, 6, 7, 8, 9, 10, 11, 12, 13, 14, 15, 16, 17, 18 or 19 amino acid substitutions.

The recombinant RSV F protein stabilized in a prefusion conformation can be placed anywhere in the scaffold, as long as the resulting epitope-scaffold protein is specifically bound by a prefusion-specific antibody (e.g., D25 or AM22 antibody), and/or includes a RSV F prefusion specific conformation (such as antigenic site Ø), in the absence of binding by the corresponding prefusion-specific antibody (e.g., D25 or AM22 antibody). Methods for determining if a particular epitope-scaffold protein is specifically bound by a prefusion-specific antibody (e.g., D25 or AM22 antibody) are disclosed herein and known to the person of ordinary skill in the art (see, for example, International Application Pub. Nos. WO 2006/091455 and WO 2005/111621). In addition, the formation of an antibody-antigen complex can be assayed using a number of well-defined diagnostic assays including conventional immunoassay formats to detect and/or quantitate antigen-specific antibodies. Such assays include, for example, enzyme immunoassays, e.g., ELISA, cell-based assays, flow cytometry, radioimmunoassays, and immunohistochemical staining. Numerous competitive and non-competitive protein binding assays are known in the art and many are commercially available. Methods for determining if a particular epitope-scaffold protein includes a RSV F prefusion specific conformation (such as antigenic site Ø), in the absence of binding by the corresponding prefusion-specific antibody (e.g., D25 or AM22 antibody) are also described herein and further known to the person of ordinary skill in the art.

3. Virus-Like Particles

In some embodiments, a virus-like particle (VLP) is provided that includes a disclosed recombinant RSV F protein stabilized in a prefusion conformation. VLPs lack the viral components that are required for virus replication and thus represent a highly attenuated form of a virus. The VLP can display a polypeptide (e.g., a recombinant RSV F protein stabilized in a prefusion conformation) that is capable of eliciting an immune response to RSV when administered to a subject. Virus like particles and methods of their production are known and familiar to the person of ordinary skill in the art, and viral proteins from several viruses are known to form VLPs, including human papillomavirus, HIV (Kang et al., Biol. Chem. 380: 353-64 (1999)), Semliki-Forest virus (Notka et al., Biol. Chem. 380: 341-52 (1999)), human polyomavirus (Goldmann et al., J. Virol. 73: 4465-9 (1999)), rotavirus (Jiang et al., Vaccine 17: 1005-13 (1999)), parvovirus (Casal, Biotechnology and Applied Biochemistry, Vol 29, Part 2, pp 141-150 (1999)), canine parvovirus (Hurtado et al., J. Virol. 70: 5422-9 (1996)), hepatitis E virus (Li et al., J. Virol. 71: 7207-13 (1997)), and Newcastle disease virus. For example, a chimeric VLP containing a RSV antigen and can be a Newcastle disease virus-based VLP. Newcastle disease based VLPs have previously been shown to elicit a neutralizing immune response to RSV in mice. The formation of such VLPs can be detected by any suitable technique. Examples of suitable techniques known in the art for detection of VLPs in a medium include, e.g., electron microscopy techniques, dynamic light scattering (DLS), selective chromatographic separation (e.g., ion exchange, hydrophobic interaction, and/or size exclusion chromatographic separation of the VLPs) and density gradient centrifugation.

In some embodiments, the virus like particle includes a recombinant RSV F protein including an F2 polypeptide and a F1 polypeptide (such as an F1 polypeptide linked to a transmembrane domain), wherein the F1 polypeptide includes a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the virus like particle includes a recombinant RSV F protein including an F2 polypeptide and a F1 polypeptide (such as an F1 polypeptide linked to a transmembrane domain), wherein the F1 polypeptide includes S155C, S290C, and S190F amino acid substitutions, S155C, S290C, and S190W amino acid substitutions, or S155C, S290C, and S190L amino acid substitutions. In further embodiments, the virus like particle includes a recombinant RSV F protein including an F2 polypeptide and a F1 polypeptide (such as an F1 polypeptide linked to a transmembrane domain), wherein the F1 polypeptide includes S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

In some embodiments, the virus like particle includes a recombinant RSV F protein including an F2 polypeptide and a F1 polypeptide (such as an F1 polypeptide linked to a transmembrane domain), wherein the F2 polypeptide and the $F_1$ polypeptide include the amino acid sequence set forth as positions 26-109 and 137-513, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions).

In several embodiments, the virus like particle includes a recombinant RSV F protein including a $F_1$ polypeptide (such as an F1 polypeptide linked to a transmembrane domain) and a $F_2$ polypeptide from a human RSV A subtype, a human RSV B subtype, or a bovine RSV, wherein the F1 polypeptide includes any of the stabilizing modifications described herein (e.g., one of the above combinations of stabilizing substitutions such as S155C, S290C, and S190F substitutions, or S155C, S290C, S190F, and V207L substitutions).

4. Protein Nanoparticles

In some embodiments a protein nanoparticle is provided that includes one or more of any of the disclosed recombinant RSV F protein stabilized in a prefusion conformation, wherein the protein nanoparticle is specifically bound by a prefusion-specific antibody (e.g., D25 or AM22 antibody), and/or includes a RSV F prefusion specific conformation (such as antigenic site Ø). Non-limiting example of nanoparticles include ferritin nanoparticles, an encapsulin nanoparticles and Sulfur Oxygenase Reductase (SOR) nanoparticles, which are comprised of an assembly of monomeric subunits including ferritin proteins, encapsulin proteins and SOR proteins, respectively. To construct protein nanoparticles including the disclosed recombinant RSV F protein stabilized in a prefusion conformation, the antigen is linked to a subunit of the protein nanoparticle (such as a ferritin protein, an encapsulin protein or a SOR protein). The fusion protein self-assembles into a nanoparticle under appropriate conditions.

Ferritin nanoparticles and their use for immunization purposes (e.g., for immunization against influenza antigens) has been disclosed in the art (see, e.g., Kanekiyo et al., Nature, 499:102-106, 2013, incorporated by reference herein in its entirety).

In some embodiments, any of the disclosed recombinant RSV F proteins stabilized in a prefusion conformation linked to a ferritin polypeptide or hybrid of different ferritin polypeptides to construct a ferritin protein nanoparticle, wherein the ferritin nanoparticle is specifically bound by a prefusion-specific antibody (e.g., D25 or AM22 antibody), and/or includes a RSV F prefusion specific conformation (such as antigenic site Ø). Ferritin is a globular protein that is found in all animals, bacteria, and plants, and which acts primarily to control the rate and location of polynuclear $Fe(III)_2O_3$ formation through the transportation of hydrated iron ions and protons to and from a mineralized core. The globular form of ferritin is made up of monomeric subunits, which are polypeptides having a molecule weight of approximately 17-20 kDa. An example of the sequence of one such monomeric subunit is represented by SEQ ID NO: 353. Each monomeric subunit has the topology of a helix bundle which includes a four antiparallel helix motif, with a fifth shorter helix (the c-terminal helix) lying roughly perpendicular to the long axis of the 4 helix bundle. According to convention, the helices are labeled 'A, B, C, D & E' from the N-terminus respectively. The N-terminal sequence lies adjacent to the capsid three-fold axis and extends to the surface, while the E helices pack together at the four-fold axis with the C-terminus extending into the capsid core. The consequence of this packing creates two pores on the capsid surface. It is expected that one or both of these pores represent the point by which the hydrated iron diffuses into and out of the capsid. Following production, these monomeric subunit proteins self-assemble into the globular ferritin protein. Thus, the globular form of ferritin comprises 24 monomeric, subunit proteins, and has a capsid-like structure having 432 symmetry. Methods of constructing ferritin nanoparticles are known to the person of ordinary skill in the art and are further described herein (see, e.g., Zhang, *Int. J. Mol. Sci.*, 12:5406-5421, 2011, which is incorporated herein by reference in its entirety).

In specific examples, the ferritin polypeptide is *E. coli* ferritin, *Helicobacter pylori* ferritin, human light chain ferritin, bullfrog ferritin or a hybrid thereof, such as *E. coli*-human hybrid ferritin, *E. coli*-bullfrog hybrid ferritin, or human-bullfrog hybrid ferritin. Exemplary amino acid sequences of ferritin polypeptides and nucleic acid sequences encoding ferritin polypeptides for use in the disclosed RSV F protein antigens stabilized in a prefusion conformation can be found in GENBANK®, for example at accession numbers ZP_03085328, ZP_06990637, EJB64322.1, AAA35832, NP_000137 AAA49532, AAA49525, AAA49524 and AAA49523, which are specifically incorporated by reference herein in their entirety as available Feb. 28, 2013. In one embodiment, any of the disclosed recombinant RSV F proteins stabilized in a prefusion conformation is linked to a ferritin protein including an amino acid sequence at least 80% (such as at least 85%, at least 90%, at least 95%, or at least 97%) identical to amino acid sequence set forth as SEQ ID NO: 353. A specific example of the disclosed recombinant RSV F proteins stabilized in a prefusion conformation linked to a ferritin protein include the amino acid sequence set forth as SEQ ID NO: 350.

In some embodiments, the ferritin polypeptide is a *Helicobacter pylori* ferritin (such as a ferritin polypeptide set forth as SEQ ID NO: 353) and includes a substitution of the cysteine residue at position 31, such as a C31S, C31A or C31V substitution. Any of the disclosed recombinant RSV F proteins (e.g., a RSV F polypeptide with S155C, S290C, and S190F substitutions, or with S155C, S290C, S190F and V207L substitutions) can be linked to a *Helicobacter pylori* ferritin (such as a ferritin polypeptide set forth as SEQ ID NO: 353) that further includes a substitution of the cysteine residue at position 31 of the ferritin polypeptide, such as a C31S, C31A or C31V substitution.

In some embodiments, the ferritin protein nanoparticle includes a recombinant RSV F protein including an F2 polypeptide and a F1 polypeptide, wherein the F1 polypeptide is linked to the ferritin protein, and wherein the F1 polypeptide includes a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the ferritin protein nanoparticle includes a recombinant RSV F protein including an $F_2$ polypeptide and a F1 polypeptide, wherein the F1 polypeptide is linked to the ferritin protein, and wherein the F1 polypeptide includes S155C, S290C, and S190F amino acid substitutions, S155C, S290C, and S190W amino acid substitutions, or S155C, S290C, and S190L amino acid substitutions. In further embodiments, the ferritin protein nanoparticle includes a recombinant RSV F protein including an F2 polypeptide and a F1 polypeptide, wherein the F1 polypeptide is linked to the ferritin protein, and wherein the F1 polypeptide includes S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

The RSV F protein included on the ferritin nanoparticle can be a human subtype A, human subtype B or bovine RSV F protein include the substitutions disclosed herein for prefusion stabilization.

In some embodiments, the ferritin protein nanoparticle includes a recombinant RSV F protein including an F2 polypeptide and a F1 polypeptide, wherein the F1 polypeptide is linked to the ferritin protein, and wherein the F2 polypeptide and the $F_1$ polypeptide include the amino acid sequence set forth as positions 26-109 and 137-513, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions). In one non-limiting embodiment, the In several embodiments, the ferritin protein nanoparticle includes a recombinant RSV F protein including a $F_1$ polypeptide and a $F_2$ polypeptide from a human RSV A subtype, a human RSV B subtype, or a bovine RSV, wherein the F1 polypeptide includes any of the stabilizing modifications described herein (e.g., one of the above combinations of stabilizing substitutions such as S155C, S290C, and S190F substitutions, or S155C, S290C, S190F, and V207L substitutions).

In some embodiments the ferritin nanoparticle includes a recombinant RSV F protein including an F2 polypeptide and a $F_1$ polypeptide, wherein the $F_1$ polypeptide is linked to the ferritin protein, and wherein the F2 polypeptide and the $F_1$ polypeptide linked to the ferritin protein include the amino acid sequence set forth as positions 26-109 and 137-679, respectively of SEQ ID NO: 377 (RSV A including S155C, S290C, S190F, V207L amino acid substitutions, with C-terminal ferritin domain), or SEQ ID NOs: 378-382.

In some embodiments the ferritin nanoparticle includes a recombinant RSV F protein including an F2 polypeptide and a F1 polypeptide, wherein the F1 polypeptide is linked to ferritin, and wherein the F2 polypeptide and the $F_1$ polypeptide linked to ferritin include the amino acid substitutions listed in row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 of column 3 of Table 8e. In some embodiments the ferritin nanoparticle includes a recombinant RSV F protein including an F2 polypeptide and a F1 polypeptide, wherein the F1 polypeptide is linked to the ferritin protein, and wherein the $F_2$ polypeptide and the $F_1$ polypeptide linked to the ferritin protein include the amino acid sequence of the $F_1$ and $F_2$ polypeptide set forth in the SEQ ID NO listed in row 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 of column 4 of Table 8e. It will be appreciated that SEQ ID NOs. 602-617 and 620-634 and 645-650 listed in Table 8e include signal sequence and pep27 polypeptide sequences, which are removed by proteolytic processing when the corresponding F protein is made in eukaryotic cells, as well as C-terminal protein tags.

TABLE 8e

Exemplary RSV F protein mutations and sequences for production of ferritin nanoparticles

| row | Description | Substitutions/modifications | SEQ ID NO |
|---|---|---|---|
| 1 | Cavity filling | (S155C, S290C, S190F, V207L) + L230F | 602 |
| 2 | Cavity filling | (S155C, S290C, S190F, V207L) + L158F | 603 |
| 3 | Cavity filling | (S155C, S290C, S190F, V207L) + L230F/L158F | 604 |
| 4 | DSCav1 + replace exposed hydrophobic residues | (S155C, S290C, S190F, V207L) + L160K/V178T/L258K/V384T/I431S/L467Q/ | 605 |
| 5 | DSCav1 + replace exposed hydrophobic residues | (S155C, S290C, S190F, V207L) + F477K/L481Q/V482K/L503Q/I506K | 606 |
| 6 | DSCav1 + replace exposed hydrophobic residues | (S155C, S290C, S190F, V207L) + L160K/V178T/L258K/V384T/ I431S/L467Q/F477K/ L481Q/V482K/L503Q/I506K | 607 |
| 7 | Cavity filling + replace exposed hydrophobic residues | (S155C, S290C, S190F, V207L) + L158F/L230F/L83F/V90F/I506K/ I395F/V185F/T54A | 608 |
| 8 | Cavity filling + replace exposed hydrophobic residues | (S155C, S290C, S190F, V207L) + L83F/V90F/I506K | 609 |
| 9 | DS-S190F with C-terminal Cys ring1 | S190F, S155C, S290C, F488W, L513C, A514E, I515C | 610 |
| 10 | DS-S190F with C-terminal Cys ring2 | S190F, S155C, S290C, F488W, L513C, A514E, G515E, 516C | 611 |
| 11 | DS-S190F with C-terminal Cys ring3 | S190F, S155C, S290C, F488W, L512C, L513E, A514C | 612 |
| 12 | DS-S190F with C-terminal Cys ring4 | S190F, S155C, S290C, F488W, L512C, L513E, A514E, G515C | 613 |
| 13 | DS-S190F with Foldon | S190F, S155C, S290C, F488W, Foldon | 614 |
| 14 | DS S190F with 1 extra disulfide bridge with Foldon | S190F, S155C, S290C, L171C, K191C, F488W, Foldon | 615 |
| 15 | DS S190F with 2 extra disulfide bridges with Foldon | S190F, S155C, S290C, A424C, V450C, L171C, K191C, F488W, Foldon | 616 |
| 16 | DS-S190F with 3 extra disulfide bridges with Foldon | K77C, I217C, S190F, S155C, S290C, A424C, V450C, L171C, K191C, F488W, Foldon | 617 |
| 17 | Single chain and shorten F protein to end at residue 513 | Single chain F with (S155C, S290C, S190F, V207L) | 618 |
| 18 | Single chain and shorten F protein to end at residue 492 | Single chain F with(S155C, S290C, S190F, V207L) | 619 |
| 19 | Disulfide | ferritin: S29C/C31S/V68C | 620 |
| 20 | Disulfide | ferritin: C31S/A115C/H128C | 621 |
| 21 | Disulfide + cavity filling | L158F/L203F/V296I; Ferritin: S29C/C31S/V68C/A115C/H128C | 622 |
| 22 | Disulfide + cavity filling | Y198F/T219L/K226M; ferritin: C31S/A115C/H128C | 623 |
| 23 | Disulfide + cavity filling | E82V/K226M/N227L/V296I; ferritin: C31S/A115C/H128C | 624 |
| 24 | Improved purification of DSCav1 Ferritin particles | (S155C, S290C, S190F, V207L) + and DYKDDDDKGG (Res. 26-35 of SEQ ID NO: 625) insertion at N-terminus of F | 625 |

TABLE 8e-continued

Exemplary RSV F protein mutations and sequences for production of ferritin nanoparticles

| row | Description | Substitutions/modifications | SEQ ID NO |
|---|---|---|---|
| 25 | Improved purification of DSCav1 Ferritin particles | (S155C, S290C, S190F, V207L) + and QHHHHHHGG (Res. 26-34 of SEQ ID NO: 626) insertion at N-terminus F | 626 |
| 26 | Improved purification of DSCav1 Ferritin particles | (S155C, S290C, S190F, V207L) + and QHHHHHHHGG (Res. 26-36 of SEQ ID NO: 627) insertion at N-terminus F | 627 |
| 27 | Improved purification of DSCav1 Ferritin particles | (S155C, S290C, S190F, V207L) + and GGHHHHHHGG (Res. 328-337 of SEQ ID NO: 628) insertion at residue 327 of F | 628 |
| 28 | Improved purification of DSCav1 Ferritin particles | (S155C, S290C, S190F, V207L) + and GGHHHHHHHHGG (Res. 329-339 of SEQ ID NO: 629) insertion at residue 327 of F | 629 |
| 29 | Improved purification of DSCav1 Ferritin particles | (S155C, S290C, S190F, V207L) + and HHHHH (Res. 324-338 of SEQ ID NO: 630) insertion at residue 323 of F | 630 |
| 30 | Improved purification of DSCav1 Ferritin particles | (S155C, S290C, S190F, V207L) + and QSAWSHPQFEKHHHHHHGGLVPRGSGG (Res. 26-52 of SEQ ID NO:631) insertion at N-terminus of F | 631 |
| 31 | Improved purification of DSCav1 Ferritin particles | (S155C, S290C, S190F, V207L) + and QSAWSHPQFEKHHHHHHGGLVPRGSGG (Res. 26-52 of SEQ ID NO: 631) insertion at N-terminus of F | 632 |
| 32 | Longer linker between RSV F DSCav1 and Ferritin | (S155C, S290C, S190F, V207L) + 10 aa linker to Ferritin | 633 |
| 33 | Longer linker between RSV F DSCav1 and Ferritin | (S155C, S290C, S190F, V207L) + N500Q + 10 aa linker to Ferritin | 634 |
| 34 | single chain end at residue 513, longer linker | DS-Cav1 single chain with longer linker | 635 |
| 35 | single chain end at residue 492 longer linker | DS-Cav1 single chain with longer linker | 636 |
| 36 | single chain end at residue 513, N500Q remove glycan | DS-Cav1 single chain with N500Q | 637 |
| 37 | single chain end at residue 513, longer linker N500Q remove glycan | DS-Cav1 single chain with longer linker N500Q | 638 |
| 38 | single chain RSV F DS-Cav1 and Ferritin | S155C, S290C, S190F, V207L single chain N105-G145 linkGS | 639 |
| 39 | single chain RSV F DS-Cav1 and Ferritin end at 492 | S155C, S290C, S190F, V207L, N500Q single chain end at 492 N105-G145 linkGS | 640 |
| 40 | single chain RSV F DS-Cav1 and Ferritin longer linker | S155C, S290C, S190F, V207L single chain N105-G145 + 10 aa linker to Ferritin | 641 |
| 41 | single chain RSV F DS-Cav1 and Ferritin end at 492 longer linker | S155C, S290C, S190F, V207L, N500Q single chain end at 492 N105-G145 + 10 aa linker to Ferritin | 642 |
| 42 | single chain RSV F DS-Cav1 and Ferritin and remove N500 glycan | S155C, S290C, S190F, V207L, N500Q single chain N105-G145 linkGS | 643 |
| 43 | single chain RSV F DS-Cav1 and Ferritin longer linker single chain and remove N500 glycan | S155C, S290C, S190F, V207L, N500Q single chain N105-G145 + 10 aa linker to Ferritin | 644 |
| 44 | DS-cav1 + exposed hydrophobic + 10 aa linker | DS-cav1 + L160K/V178T/L258K/V384T/ I431S/L467Q/ + 10 aa linker | 645 |
| 45 | DS-cav1 + exposed hydrophobic + 10 aa linker | DS-cav1 + F477K/L481Q/ V482K/L503Q/I506K + 10 aa linker | 646 |
| 46 | DS-cav1 + exposed hydrophobic + 10 aa linker | DS-cav1 + L160K/V178T/L258K/V384T/ I431S/L467Q/F477K/ L481Q/V482K/L503Q/I506K + 10 aa linker | 647 |
| 47 | DS-cav1 + exposed hydrophobic + 10 aa linker + N500 glycan removal | DS-cav1 + L160K/V178T/L258K/V384T/ I431S/L467Q/ + 10 aa linker + N500Q | 648 |

TABLE 8e-continued

Exemplary RSV F protein mutations and sequences for production of ferritin nanoparticles

| row | Description | Substitutions/modifications | SEQ ID NO |
|---|---|---|---|
| 48 | DS-CAV1 + exposed hydrophobic + 10 aa linker + N500 glycan removal | DS-cav1 + F477K/L481Q/ V482K/L503Q/I506K + 10 aa linker + N500Q | 649 |
| 49 | DS-cav1 + exposed hydrophobic + 10 aa linker + N500 glycan removal | DS-cav1 + L160K/V178T/L258K/V384T/ I431S/L467Q/F477K/ L481Q/V482K/L503Q/I506K+ 10 aa linker + N500Q | 650 |

In additional embodiments, any of the disclosed RSV F protein antigens stabilized in a prefusion conformation are linked to an encapsulin polypeptide to construct an encapsulin nanoparticle, wherein the encapsulin nanoparticle is specifically bound by a prefusion-specific antibody (e.g., D25 or AM22 antibody), and/or includes a RSV F prefusion specific conformation (such as antigenic site Ø). Encapsulin proteins are a conserved family of bacterial proteins also known as linocin-like proteins that form large protein assemblies that function as a minimal compartment to package enzymes. The encapsulin assembly is made up of monomeric subunits, which are polypeptides having a molecule weight of approximately 30 kDa. An example of the sequence of one such monomeric subunit is provided as SEQ ID NO: 354. Following production, the monomeric subunits self-assemble into the globular encapsulin assembly including 60 monomeric subunits. Methods of constructing encapsulin nanoparticles are known to the person of ordinary skill in the art, and further described herein (see, for example, Sutter et al., Nature Struct. and Mol. Biol., 15:939-947, 2008, which is incorporated by reference herein in its entirety). In specific examples, the encapsulin polypeptide is bacterial encapsulin, such as E. coli or Thermotoga maritime encapsulin. An exemplary encapsulin sequence for use with the disclosed RSV F protein antigens stabilized in a prefusion conformation is set forth as SEQ ID NO: 354.

In additional embodiments, any of the disclosed recombinant RSV F proteins stabilized in a prefusion conformation are linked to a Sulfer Oxygenase Reductase (SOR) polypeptide to construct a SOR nanoparticle, wherein the SOR nanoparticle is specifically bound by a prefusion-specific antibody (e.g., D25 or AM22 antibody), and/or includes a RSV F prefusion specific conformation (such as antigenic site Ø). SOR proteins are microbial proteins (for example from the thermoacidophilic archaeon Acidianus ambivalens that form 24 subunit protein assemblies. Methods of constructing SOR nanoparticles are known to the person of ordinary skill in the art (see, e.g., Urich et al., Science, 311:996-1000, 2006, which is incorporated by reference herein in its entirety). Specific examples of the disclosed recombinant RSV F proteins stabilized in a prefusion conformation linked to a SOR protein include the amino acid sequences set forth as SEQ ID NO: 344 and SEQ ID NO: 345.

In additional embodiments, any of the disclosed recombinant RSV F proteins stabilized in a prefusion conformation are linked to a Lumazine synthase polypeptide to construct a Lumazine synthase nanoparticle, wherein the Lumazine synthase nanoparticle is specifically bound by a prefusion-specific antibody (e.g., D25 or AM22 antibody), and/or includes a RSV F prefusion specific conformation (such as antigenic site Ø). Specific examples of the disclosed recombinant RSV F proteins stabilized in a prefusion conformation linked to a Lumazine synthase protein include the amino acid sequences set forth as SEQ ID NOs: 346-348.

In additional embodiments, any of the disclosed recombinant RSV F proteins stabilized in a prefusion conformation are linked to a pyruvate dehydrogenase polypeptide to construct a pyruvate dehydrogenase nanoparticle, wherein the pyruvate dehydrogenase nanoparticle is specifically bound by a prefusion-specific antibody (e.g., D25 or AM22 antibody), and/or includes a RSV F prefusion specific conformation (such as antigenic site Ø). A specific example of the disclosed recombinant RSV F proteins stabilized in a prefusion conformation linked to a pyruvate dehydrogenase protein include the amino acid sequence set forth as SEQ ID NO: 349.

In some examples, any of the disclosed recombinant RSV F proteins stabilized in a prefusion conformation is linked to the N- or C-terminus of a ferritin, encapsulin, SOR, lumazine synthase or pyruvate dehydrogenase protein, for example with a linker, such as a Ser-Gly linker. When the constructs have been made in HEK 293 Freestyle cells, the fusion proteins are secreted from the cells and self-assembled into nanoparticles. The nanoparticles can be purified using known techniques, for example by a few different chromatography procedures, e.g. Mono Q (anion exchange) followed by size exclusion (SUPEROSE® 6) chromatography.

Several embodiments include a monomeric subunit of a ferritin, encapsulin, SOR, lumazine synthase or pyruvate dehydrogenase protein, or any portion thereof which is capable of directing self-assembly of monomeric subunits into the globular form of the protein. Amino acid sequences from monomeric subunits of any known ferritin, encapsulin, SOR, lumazine synthase or pyruvate dehydrogenase protein can be used to produce fusion proteins with the disclosed recombinant RSV F proteins stabilized in a prefusion conformation, so long as the monomeric subunit is capable of self-assembling into a nanoparticle displaying the recombinant RSV F proteins stabilized in a prefusion conformation on its surface.

The fusion proteins need not comprise the full-length sequence of a monomeric subunit polypeptide of a ferritin, encapsulin, SOR, lumazine synthase or pyruvate dehydrogenase protein. Portions, or regions, of the monomeric subunit polypeptide can be utilized so long as the portion comprises amino acid sequences that direct self-assembly of monomeric subunits into the globular form of the protein.

In some embodiments, it may be useful to engineer mutations into the amino acid sequence of the monomeric ferritin, encapsulin, SOR, lumazine synthase or pyruvate dehydrogenase subunits. For example, it may be useful to alter sites such as enzyme recognition sites or glycosylation sites in order to give the fusion protein beneficial properties (e.g., half-life).

It will be understood by those skilled in the art that fusion of any of the disclosed recombinant RSV F proteins stabilized in a prefusion conformation to the ferritin, encapsulin, SOR, lumazine synthase or pyruvate dehydrogenase protein should be done such that the disclosed recombinant RSV F proteins stabilized in a prefusion conformation portion of the fusion protein does not interfere with self-assembly of the monomeric ferritin, encapsulin, SOR, lumazine synthase or pyruvate dehydrogenase subunits into the globular protein, and that the ferritin, encapsulin, SOR, lumazine synthase or pyruvate dehydrogenase protein portion of the fusion protein does not interfere with the ability of the disclosed recombinant RSV F protein antigen stabilized in a prefusion conformation to elicit an immune response to RSV. In some embodiments, the ferritin, encapsulin, SOR, lumazine synthase or pyruvate dehydrogenase protein and disclosed recombinant RSV F protein stabilized in a prefusion conformation can be joined together directly without affecting the activity of either portion. In other embodiments, the ferritin, encapsulin, SOR, lumazine synthase or pyruvate dehydrogenase protein and the recombinant RSV F protein stabilized in a prefusion conformation are joined using a linker (also referred to as a spacer) sequence. The linker sequence is designed to position the ferritin, encapsulin, SOR, lumazine synthase or pyruvate dehydrogenase portion of the fusion protein and the disclosed recombinant RSV F protein stabilized in a prefusion conformation portion of the fusion protein, with regard to one another, such that the fusion protein maintains the ability to assemble into nanoparticles, and also elicit an immune response to RSV. In several embodiments, the linker sequences comprise amino acids. Preferable amino acids to use are those having small side chains and/or those which are not charged. Such amino acids are less likely to interfere with proper folding and activity of the fusion protein. Accordingly, preferred amino acids to use in linker sequences, either alone or in combination are serine, glycine and alanine. One example of such a linker sequence is SGG. Amino acids can be added or subtracted as needed. Those skilled in the art are capable of determining appropriate linker sequences for construction of protein nanoparticles.

In certain embodiments, the protein nanoparticles have a molecular weight of from 100 to 5000 kDa, such as approximately 500 to 4600 kDa. In some embodiments, a Ferritin nanoparticle has an approximate molecular weight of 650 kDa, an Encapsulin nanoparticle has an approximate molecular weight of 2100 kDa, a SOR nanoparticle has an approximate molecular weight of 1000 kDa, a lumazine synthase nanoparticle has an approximate molecular weight of 4000 kDa, and a pyruvate dehydrogenase nanoparticle has an approximate molecular weight of 4600 kDa, when the protein nanoparticle include a recombinant RSV F protein stabilized in a prefusion conformation.

The disclosed recombinant RSV F proteins stabilized in a prefusion conformation linked to ferritin, encapsulin, SOR, lumazine synthase or pyruvate dehydrogenase proteins can self-assemble into multi-subunit protein nanoparticles, termed ferritin nanoparticles, encapsulin nanoparticles, SOR nanoparticles, lumazine synthase nanoparticles, and pyruvate dehydrogenase nanoparticles, respectively. The nanoparticles include the disclosed recombinant RSV F proteins stabilized in a prefusion conformation have substantially the same structural characteristics as the native ferritin, encapsulin, SOR, lumazine synthase or pyruvate dehydrogenase nanoparticles that do not include the disclosed recombinant RSV F proteins stabilized in a prefusion conformation. That is, they contain 24, 60, 24, 60, or 60 subunits (respectively) and have similar corresponding symmetry. In the case of nanoparticles constructed of monomer subunits including a disclosed recombinant RSV F protein stabilized in a prefusion conformation, such nanoparticles are specifically bound by a prefusion-specific antibody (e.g., D25 or AM22 antibody), and/or includes a RSV F prefusion specific conformation (such as antigenic site Ø).

C. Polynucleotides Encoding Antigens

Polynucleotides encoding the disclosed PreF antigens (e.g., a recombinant RSV F protein stabilized in a prefusion conformation, or epitope-scaffold protein, or virus-like particle or protein nanoparticle containing such proteins) are also provided. These polynucleotides include DNA, cDNA and RNA sequences which encode the antigen.

In some embodiments, the nucleic acid molecule encodes a precursor $F_0$ polypeptide that, when expressed in an appropriate cell, is processed into a disclosed PreF antigen. In some embodiments, the nucleic acid molecule encodes a precursor $F_0$ polypeptide that, when expressed in an appropriate cell, is processed into a disclosed PreF antigen, wherein the precursor $F_0$ polypeptide includes, from N- to C-terminus, a signal peptide, a $F_2$ polypeptide, a Pep27 polypeptide, and a $F_1$ polypeptide. In some embodiments, the Pep27 polypeptide includes the amino acid sequence set forth as positions 110-136 of any one SEQ ID NOs: 1-184 or 370, wherein the amino acid positions correspond to the amino acid sequence of a reference $F_0$ polypeptide set forth as SEQ ID NO: 124. In some embodiments, the signal peptide includes the amino acid sequence set forth as positions 1-25 of any one SEQ ID NOs: 1-184 or 370, wherein the amino acid positions correspond to the amino acid sequence of a reference $F_0$ polypeptide set forth as SEQ ID NO: 124.

In some embodiments, the nucleic acid molecule encodes a precursor $F_0$ polypeptide that, when expressed in an appropriate cell, is processed into a disclosed PreF antigen, wherein the precursor $F_0$ polypeptide includes the amino acid sequence set forth as any one of SEQ ID NOs: 185, or 189-303. In some embodiments, the nucleic acid molecule encodes a precursor $F_0$ polypeptide that, when expressed in an appropriate cell, is processed into a disclosed PreF antigen, wherein the precursor $F_0$ polypeptide includes the amino acid sequence set forth as residues 1-513 of any one of SEQ ID NOs: 185, or 189-303.

In some embodiments, the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide, and wherein the F1 polypeptide includes a disulfide bond between a pair of cysteines at positions 155 and 290, and a cavity-filling amino acid substitution at position 190; or a disulfide bond between a pair of cysteines at positions 155 and 290, a cavity-filling amino acid substitution at position 190, and a cavity-filling amino acid substitution at position 207.

In some embodiments, the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide, and wherein the F1 polypeptide includes S155C, S290C, and S190F amino acid substitutions, S155C, S290C, and S190W amino acid substitutions, or S155C, S290C, and S190L amino acid substitutions. In further embodiments, the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide, and wherein the F1 polypeptide includes S155C, S290C, S190F, and V207L amino acid substitutions, S155C, S290C, S190W, and V207L amino acid substitutions, S155C, S290C, S190L, and V207L amino acid substitutions, S155C, S290C, S190F, and V207F amino acid substitutions, S155C, S290C, S190W, and V207F amino acid substitutions, S155C, S290C, S190L, and V207F amino acid substitutions, S155C, S290C, S190F, and V207W amino acid substitutions, S155C, S290C, S190W, and V207W amino acid substitutions, or S155C, S290C, S190L, and V207W amino acid substitutions.

In some embodiments, the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide, wherein the $F_2$ polypeptide and the $F_1$ polypeptide include the amino acid sequence set forth as positions 26-109 and 137-513, respectively, of any one of SEQ ID NO: 371 (RSV A with S155C, S290C, S190F and V207L substitutions), SEQ ID NO: 372 (RSV B with S155C, S290C, S190F and V207L substitutions), SEQ ID NO: 373 (bovine RSV with S155C, S290C, S190F and V207L substitutions), SEQ ID NO: 374 (RSV A with S155C, S290C, and S190F substitutions), SEQ ID NO: 375 (RSV B with S155C, S290C, and S190F substitutions); or SEQ ID NO: 376 (bovine RSV with S155C, S290C, and S190F substitutions).

In several embodiments, the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide from a human RSV A subtype, a human RSV B subtype, or a bovine RSV, wherein the F1 polypeptide includes any of the stabilizing modifications described herein (e.g., one of the above combinations of stabilizing substitutions such as S155C, S290C, and S190F substitutions, or S155C, S290C, S190F, and V207L substitutions).

In one non-limiting example the nucleic acid molecule encodes a precursor $F_0$ polypeptide that, when expressed in an appropriate cell, is processed into a disclosed PreF antigen including a recombinant RSV F protein including an F2 polypeptide and a F1 polypeptide, wherein the F1 polypeptide is linked to a ferritin protein, and wherein the $F_2$ polypeptide and the $F_1$ polypeptide linked to the ferritin protein include the amino acid sequence set forth as positions 26-109 and 137-679, respectively of SEQ ID NO: 377 (RSV A including S155C, S290C, S190F, V207L amino acid substitutions, with C-terminal ferritin domain), or SEQ ID NOs: 378-382.

In one non-limiting example, the nucleic acid molecule includes the sequence set forth as SEQ ID NO: 383 (RSV F protein from human subtype A including S155C, S290C, S190F and V207L amino acid substitutions, fused to a C-terminal Foldon domain, thrombin cleavage site, 6×His tag and a StrepTag II).

In another non-limiting example, the nucleic acid molecule is an expression vector, and includes the sequence set forth as SEQ ID NO: 384 (RSV F protein from human subtype A including S155C, S290C, S190F and V207L amino acid substitutions, fused to a C-terminal Foldon domain, thrombin cleavage site, 6×His tag and a StrepTag II).

Methods for the manipulation and insertion of the nucleic acids of this disclosure into vectors are well known in the art (see for example, Sambrook et al., *Molecular Cloning, a Laboratory Manual,* 2d edition, Cold Spring Harbor Press, Cold Spring Harbor, N.Y., 1989, and Ausubel et al., *Current Protocols in Molecular Biology,* Greene Publishing Associates and John Wiley & Sons, New York, N.Y., 1994).

A nucleic acid encoding PreF antigens (e.g., a recombinant RSV F protein stabilized in a prefusion conformation, or epitope-scaffold protein, or virus-like particle or protein nanoparticle containing such proteins) can be cloned or amplified by in vitro methods, such as the polymerase chain reaction (PCR), the ligase chain reaction (LCR), the transcription-based amplification system (TAS), the self-sustained sequence replication system (3SR) and the Qβ replicase amplification system (QB). For example, a polynucleotide encoding the protein can be isolated by polymerase chain reaction of cDNA using primers based on the DNA sequence of the molecule. A wide variety of cloning and in vitro amplification methodologies are well known to persons skilled in the art. PCR methods are described in, for example, U.S. Pat. No. 4,683,195; Mullis et al., *Cold Spring Harbor Symp. Quant. Biol.* 51:263, 1987; and Erlich, ed., *PCR Technology,* (Stockton Press, N Y, 1989). Polynucleotides also can be isolated by screening genomic or cDNA libraries with probes selected from the sequences of the desired polynucleotide under stringent hybridization conditions.

The polynucleotides encoding PreF antigens (e.g., a recombinant RSV F protein stabilized in a prefusion conformation, or epitope-scaffold protein, or virus-like particle or protein nanoparticle containing such proteins) include a recombinant DNA which is incorporated into a vector into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

DNA sequences encoding PreF antigens (e.g., a recombinant RSV F protein stabilized in a prefusion conformation, or epitope-scaffold protein, or virus-like particle or protein nanoparticle containing such proteins) can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Polynucleotide sequences encoding PreF antigens (e.g., a recombinant RSV F protein stabilized in a prefusion conformation, or epitope-scaffold protein, or virus-like particle or protein nanoparticle containing such proteins) can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signal for introns, maintenance of the correct reading frame of that gene to permit proper translation of mRNA, and stop codons.

Hosts can include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium*, SF9 cells, C129 cells, 293 cells, *Neurospora*, and immortalized mammalian myeloid and lymphoid cell lines. Techniques for the propagation of mammalian cells in culture are well-known (see, Jakoby and Pastan (eds), 1979, Cell Culture. Methods in Enzymology, volume 58, Academic Press, Inc., Harcourt Brace Jovanovich, N.Y.). Examples of commonly used mammalian host cell lines are VERO and HeLa cells, CHO cells, and WI38, BHK, and COS cell lines, although cell lines may be used, such as cells designed to provide higher expression, desirable glycosylation patterns, or other features. In some embodiments, the host cells include HEK293 cells or derivatives thereof, such as $GnTI^{-/-}$ cells (ATCC® No. CRL-3022).

Transformation of a host cell with recombinant DNA can be carried out by conventional techniques as are well known to those skilled in the art. Where the host is prokaryotic, such as, but not limited to, *E. coli*, competent cells which are capable of DNA uptake can be prepared from cells harvested after exponential growth phase and subsequently treated by the $CaCl_2$ method using procedures well known in the art. Alternatively, $MgCl_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Eukaryotic Viral Vectors, Cold Spring Harbor Laboratory, Gluzman ed., 1982).

D. Viral Vectors

The nucleic acid molecules encoding a recombinant RSV F protein stabilized in a prefusion conformation can be included in a viral vector, for example for expression of the antigen in a host cell, or for immunization of a subject as disclosed herein. In some embodiments, the viral vectors are administered to a subject as part of a prime-boost vaccination. In several embodiments, the viral vectors are included in a vaccine, such as a primer vaccine or a booster vaccine for use in a prime-boost vaccination.

In several examples, the viral vector encoding the recombinant RSV F protein stabilized in a prefusion conformation can be replication-competent. For example, the viral vector can have a mutation (e.g., insertion of nucleic acid encoding the PreF antigen) in the viral genome that does not inhibit viral replication in host cells. The viral vector also can be conditionally replication-competent. In other examples, the viral vector is replication-deficient in host cells.

In several embodiments, the recombinant RSV F protein stabilized in a prefusion conformation is expressed by a viral vector that can be delivered via the respiratory tract. For example, a paramyxovirus (PIV) vector, such as bovine parainfluenza virus (BPIV) vector (e.g., a BPIV-1, BPIV-2, or BPV-3 vector) or human PIV vector, a metapneumovirus (MPV) vector, a Sendia virus vector, or a measles virus vector, is used to express a disclosed antigen. A BPIV3 viral vector expressing the RSV F and the hPIV F proteins (MEDI-534) is currently in clinical trials as a RSV vaccine. Examples of paramyxovirus (PIV) vector for expressing antigens are known to the person of skill in the art (see, e.g., U.S. Pat. App. Pubs. 2012/0045471, 2011/0212488, 2010/0297730, 2010/0278813, 2010/0167270, 2010/0119547, 2009/0263883, 2009/0017517, 2009/0004722, 2008/0096263, 2006/0216700, 2005/0147623, 2005/0142148, 2005/0019891, 2004/0208895, 2004/0005545, 2003/0232061, 2003/0095987, and 2003/0072773; each of which is incorporated by reference herein in its entirety). In another example, a Newcastle disease viral vector is used to express a disclosed antigen (see, e.g., McGinnes et al., J. Virol., 85: 366-377, 2011, describing RSV F and G proteins expressed on Newcastle disease like particles, incorporated by reference in its entirety). In another example, a Sendai virus vector is used to express a disclosed antigen (see, e.g., Jones et al., Vaccine, 30:959-968, 2012, incorporated by reference herein in its entirety, which discloses use of a Sendai virus-based RSV vaccine to induce an immune response in primates).

Additional viral vectors are also available for expression of the disclosed antigens, including polyoma, i.e., SV40 (Madzak et al., 1992, *J. Gen. Virol.*, 73:15331536), adenovirus (Berkner, 1992, *Cur. Top. Microbiol. Immunol.*, 158: 39-6; Berliner et al., 1988, *Bio Techniques*, 6:616-629; Gorziglia et al., 1992, *J. Virol.*, 66:4407-4412; Quantin et al., 1992, *Proc. Natl. Acad. Sci. USA*, 89:2581-2584; Rosenfeld et al., 1992, *Cell*, 68:143-155; Wilkinson et al., 1992, *Nucl. Acids Res.*, 20:2233-2239; Stratford-Perricaudet et al., 1990, *Hum. Gene Ther.*, 1:241-256), vaccinia virus (Mackett et al., 1992, *Biotechnology*, 24:495-499), adeno-associated virus (Muzyczka, 1992, *Curr. Top. Microbiol. Immunol.*, 158:91-123; On et al., 1990, *Gene*, 89:279-282), herpes viruses including HSV and EBV and CMV (Margolskee, 1992, *Curr. Top. Microbiol. Immunol.*, 158:67-90; Johnson et al., 1992, *J. Virol.*, 66:29522965; Fink et al., 1992, *Hum. Gene Ther.* 3:11-19; Breakfield et al., 1987, *Mol. Neurobiol.*, 1:337-371; Fresse et al., 1990, *Biochem. Pharmacol.*, 40:2189-2199), Sindbis viruses (H. Herweijer et al., 1995, *Human Gene Therapy* 6:1161-1167; U.S. Pat. Nos. 5,091, 309 and 5,217,879), alphaviruses (S. Schlesinger, 1993, *Trends Biotechnol.* 11:18-22; I. Frolov et al., 1996, *Proc. Natl. Acad. Sci. USA* 93:11371-11377) and retroviruses of avian (Brandyopadhyay et al., 1984, *Mol. Cell Biol.*, 4:749-754; Petropouplos et al., 1992, *J. Virol.*, 66:3391-3397), murine (Miller, 1992, *Curr. Top. Microbiol. Immunol.*, 158: 1-24; Miller et al., 1985, *Mol. Cell Biol.*, 5:431-437; Sorge et al., 1984, *Mol. Cell Biol.*, 4:1730-1737; Mann et al., 1985, *J. Virol.*, 54:401-407), and human origin (Page et al., 1990, *J. Virol.*, 64:5370-5276; Buchschalcher et al., 1992, *J. Virol.*, 66:2731-2739). Baculovirus (*Autographa californica* multinuclear polyhedrosis virus; AcMNPV) vectors are also known in the art, and may be obtained from commercial sources (such as PharMingen, San Diego, Calif.; Protein Sciences Corp., Meriden, Conn.; Stratagene, La Jolla, Calif.). Additional viral vectors are familiar to the person of ordinary skill in the art.

In several embodiments, the methods and compositions disclosed herein include an adenoviral vector that expresses a recombinant RSV F protein stabilized in a prefusion conformation. Adenovirus from various origins, subtypes, or mixture of subtypes can be used as the source of the viral genome for the adenoviral vector. Non-human adenovirus (e.g., simian, chimpanzee, gorilla, avian, canine, ovine, or bovine adenoviruses) can be used to generate the adenoviral vector. For example, a simian adenovirus can be used as the source of the viral genome of the adenoviral vector. A simian adenovirus can be of serotype 1, 3, 7, 11, 16, 18, 19, 20, 27, 33, 38, 39, 48, 49, 50, or any other simian adenoviral serotype. A simian adenovirus can be referred to by using any suitable abbreviation known in the art, such as, for example, SV, SAdV, SAV or sAV. In some examples, a simian adenoviral vector is a simian adenoviral vector of serotype 3, 7, 11, 16, 18, 19, 20, 27, 33, 38, or 39. In one example, a chimpanzee serotype C Ad3 vector is used (see, e.g., Peruzzi et al., Vaccine, 27:1293-1300, 2009). Human adenovirus can be used as the source of the viral genome for the adenoviral vector. Human adenovirus can be of various subgroups or serotypes. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22, 23, 24, 25, 26, 27, 28, 29, 30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serotype. The person of ordinary skill in the art is familiar with replication competent and deficient adenoviral vectors (including singly and multiply replication deficient adenoviral vectors). Examples of replication-deficient adenoviral vectors, including multiply replication-deficient adenoviral vectors, are disclosed in U.S. Pat. Nos. 5,837,511; 5,851,806; 5,994,106; 6,127,175; 6,482,616; and 7,195,896, and International Patent Application Nos. WO 94/28152, WO 95/02697, WO 95/16772, WO 95/34671, WO 96/22378, WO 97/12986, WO 97/21826, and WO 03/02231 1.

E. Compositions

The disclosed PreF antigens, viral vectors, and nucleic acid molecules can be included in a pharmaceutical composition, including therapeutic and prophylactic formulations, and can be combined together with one or more adjuvants and, optionally, other therapeutic ingredients, such as antiviral drugs. In several embodiments, compositions including one or more of the disclosed PreF antigens, viral vectors, or nucleic acid molecules are immunogenic compositions. The composition can include any of the PreF antigens including a recombinant RSV F protein as disclosed herein, (such as a protein nanoparticle including any of the recombinant RSV F proteins as disclosed herein), a virus-like particle including any of the recombinant RSV F proteins as disclosed herein, a nucleic acid molecule encoding any of the recombinant RSV F proteins as disclosed herein, or a vector encoding or including any of the recombinant RSV F proteins as disclosed herein.

In some embodiments, the composition includes a first isolated antigen including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second isolated antigen including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments, the composition includes a first protein nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second protein nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments, the composition includes a first viral vector including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second viral vector including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments, the composition includes a first virus-like particle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second virus-like particle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments, the composition includes a first nucleic acid molecule (such as an expression vector) encoding a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second nucleic acid molecule (such as an expression vector) including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

Such pharmaceutical compositions can be administered to subjects by a variety of administration modes known to the person of ordinary skill in the art, for example, nasal, pulmonary, intramuscular, subcutaneous, intravenous, intraperitoneal, or parenteral routes.

To formulate the compositions, the disclosed PreF antigens, viral vectors, or nucleic acid molecules can be combined with various pharmaceutically acceptable additives, as well as a base or vehicle for dispersion of the conjugate. Desired additives include, but are not limited to, pH control agents, such as arginine, sodium hydroxide, glycine, hydrochloric acid, citric acid, and the like. In addition, local anesthetics (for example, benzyl alcohol), isotonizing agents (for example, sodium chloride, mannitol, sorbitol), adsorption inhibitors (for example, TWEEN® 80), solubility enhancing agents (for example, cyclodextrins and derivatives thereof), stabilizers (for example, serum albumin), and reducing agents (for example, glutathione) can be included. Adjuvants, such as aluminum hydroxide (ALHYDROGEL®, available from Brenntag Biosector, Copenhagen, Denmark and AMPHOGEL®, Wyeth Laboratories, Madison, N.J.), Freund's adjuvant, MPL™ (3-O-deacylated monophosphoryl lipid A; Corixa, Hamilton, In.), IL-12 (Genetics Institute, Cambridge, Mass.) TLR agonists (such as TLR-9 agonists), among many other suitable adjuvants well known in the art, can be included in the compositions.

When the composition is a liquid, the tonicity of the formulation, as measured with reference to the tonicity of 0.9% (w/v) physiological saline solution taken as unity, is typically adjusted to a value at which no substantial, irreversible tissue damage will be induced at the site of administration. Generally, the tonicity of the solution is adjusted to a value of about 0.3 to about 3.0, such as about 0.5 to about 2.0, or about 0.8 to about 1.7.

The disclosed PreF antigens, viral vectors, or nucleic acid molecules can be dispersed in a base or vehicle, which can include a hydrophilic compound having a capacity to disperse the antigens, and any desired additives. The base can be selected from a wide range of suitable compounds, including but not limited to, copolymers of polycarboxylic acids or salts thereof, carboxylic anhydrides (for example, maleic anhydride) with other monomers (for example, methyl (meth)acrylate, acrylic acid and the like), hydrophilic vinyl polymers, such as polyvinyl acetate, polyvinyl alcohol, polyvinylpyrrolidone, cellulose derivatives, such as hydroxymethylcellulose, hydroxypropylcellulose and the like, and natural polymers, such as chitosan, collagen, sodium alginate, gelatin, hyaluronic acid, and nontoxic metal salts thereof. Often, a biodegradable polymer is selected as a base or vehicle, for example, polylactic acid, poly(lactic acid-glycolic acid) copolymer, polyhydroxybutyric acid, poly(hydroxybutyric acid-glycolic acid) copolymer and mixtures thereof. Alternatively or additionally, synthetic fatty acid esters such as polyglycerin fatty acid esters, sucrose fatty acid esters and the like can be employed as vehicles. Hydrophilic polymers and other vehicles can be used alone or in combination, and enhanced structural integrity can be imparted to the vehicle by partial crystallization, ionic bonding, cross-linking and the like. The vehicle can be provided in a variety of forms, including fluid or viscous solutions, gels, pastes, powders, microspheres and films, for examples for direct application to a mucosal surface.

The disclosed PreF antigens, viral vectors, or nucleic acid molecules can be combined with the base or vehicle according to a variety of methods, and release of the antigens can be by diffusion, disintegration of the vehicle, or associated formation of water channels. In some circumstances, the disclosed antigens, or a nucleic acid or a viral vector encoding, expressing or including the antigen, is dispersed in microcapsules (microspheres) or nanocapsules (nanospheres) prepared from a suitable polymer, for example, isobutyl 2-cyanoacrylate (see, for example, Michael et al., *J. Pharmacy Pharmacol.* 43:1-5, 1991), and dispersed in a biocompatible dispersing medium, which yields sustained delivery and biological activity over a protracted time.

The pharmaceutical compositions can contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, and triethanolamine oleate. For solid compositions, conventional nontoxic pharmaceutically acceptable vehicles can be used which include, for example, pharmaceutical grades of mannitol, lactose, starch, magnesium stearate, sodium saccharin, talcum, cellulose, glucose, sucrose, magnesium carbonate, and the like.

Pharmaceutical compositions for administering the disclosed PreF antigens, viral vectors, or nucleic acid molecules can also be formulated as a solution, microemulsion, or other ordered structure suitable for high concentration of active ingredients. The vehicle can be a solvent or dispersion medium containing, for example, water, ethanol, polyol (for example, glycerol, propylene glycol, liquid polyethylene glycol, and the like), and suitable mixtures thereof. Proper fluidity for solutions can be maintained, for example, by the use of a coating such as lecithin, by the maintenance of a desired particle size in the case of dispersible formulations, and by the use of surfactants. In many cases, it will be desirable to include isotonic agents, for example, sugars, polyalcohols, such as mannitol and sorbitol, or sodium chloride in the composition. Prolonged absorption of the disclosed antigens can be brought about by including in the composition an agent which delays absorption, for example, monostearate salts and gelatin.

In certain embodiments, the disclosed PreF antigens, viral vectors, or nucleic acid molecules can be administered in a time-release formulation, for example in a composition that includes a slow release polymer. These compositions can be prepared with vehicles that will protect against rapid release, for example a controlled release vehicle such as a polymer, microencapsulated delivery system or bioadhesive gel. Prolonged delivery in various compositions of the disclosure can be brought about by including in the composition agents that delay absorption, for example, aluminum monostearate hydrogels and gelatin. When controlled release formulations are desired, controlled release binders suitable for use in accordance with the disclosure include any biocompatible controlled release material which is inert to the active agent and which is capable of incorporating the disclosed antigen and/or other biologically active agent. Numerous such materials are known in the art. Useful controlled-release binders are materials that are metabolized slowly under physiological conditions following their delivery (for example, at a mucosal surface, or in the presence of bodily fluids). Appropriate binders include, but are not limited to, biocompatible polymers and copolymers well known in the art for use in sustained release formulations. Such biocompatible compounds are non-toxic and inert to surrounding tissues, and do not trigger significant adverse side effects, such as nasal irritation, immune response, inflammation, or the like. They are metabolized into metabolic products that are also biocompatible and easily eliminated from the body. Numerous systems for controlled delivery of therapeutic proteins are known (e.g., U.S. Pat. No. 5,055,303; U.S. Pat. No. 5,188,837; U.S. Pat. No. 4,235,871; U.S. Pat. No. 4,501,728; U.S. Pat. No. 4,837,028; U.S. Pat. No. 4,957,735; and U.S. Pat. No. 5,019,369; U.S. Pat. No. 5,055,303; U.S. Pat. No.

5,514,670; U.S. Pat. No. 5,413,797; U.S. Pat. No. 5,268,164; U.S. Pat. No. 5,004,697; U.S. Pat. No. 4,902,505; U.S. Pat. No. 5,506,206; U.S. Pat. No. 5,271,961; U.S. Pat. No. 5,254,342; and U.S. Pat. No. 5,534,496).

Exemplary polymeric materials for use include, but are not limited to, polymeric matrices derived from copolymeric and homopolymeric polyesters having hydrolyzable ester linkages. A number of these are known in the art to be biodegradable and to lead to degradation products having no or low toxicity. Exemplary polymers include polyglycolic acids and polylactic acids, poly(DL-lactic acid-co-glycolic acid), poly(D-lactic acid-co-glycolic acid), and poly(L-lactic acid-co-glycolic acid). Other useful biodegradable or bio-erodible polymers include, but are not limited to, such polymers as poly(epsilon-caprolactone), poly(epsilon-aprolactone-CO-lactic acid), poly(epsilon.-aprolactone-CO-glycolic acid), poly(beta-hydroxy butyric acid), poly(alkyl-2-cyanoacrilate), hydrogels, such as poly(hydroxyethyl methacrylate), polyamides, poly(amino acids) (for example, L-leucine, glutamic acid, L-aspartic acid and the like), poly(ester urea), poly(2-hydroxyethyl DL-aspartamide), polyacetal polymers, polyorthoesters, polycarbonate, polymaleamides, polysaccharides, and copolymers thereof. Many methods for preparing such formulations are well known to those skilled in the art (see, for example, *Sustained and Controlled Release Drug Delivery Systems*, J. R. Robinson, ed., Marcel Dekker, Inc., New York, 1978). Other useful formulations include controlled-release microcapsules (U.S. Pat. Nos. 4,652,441 and 4,917,893), lactic acid-glycolic acid copolymers useful in making microcapsules and other formulations (U.S. Pat. Nos. 4,677,191 and 4,728,721) and sustained-release compositions for water-soluble peptides (U.S. Pat. No. 4,675,189).

Pharmaceutical compositions typically are sterile and stable under conditions of manufacture, storage and use. Sterile solutions can be prepared by incorporating the disclosed PreF antigens, viral vectors, or nucleic acid molecules in the required amount in an appropriate solvent with one or a combination of ingredients enumerated herein, as required, followed by filtered sterilization. Generally, dispersions are prepared by incorporating the disclosed antigen and/or other biologically active agent into a sterile vehicle that contains a basic dispersion medium and the required other ingredients from those enumerated herein. In the case of sterile powders, methods of preparation include vacuum drying and freeze-drying which yields a powder of the disclosed antigen plus any additional desired ingredient from a previously sterile-filtered solution thereof. The prevention of the action of microorganisms can be accomplished by various antibacterial and antifungal agents, for example, parabens, chlorobutanol, phenol, sorbic acid, thimerosal, and the like.

Actual methods for preparing administrable compositions will be known or apparent to those skilled in the art and are described in more detail in such publications as *Remingtons Pharmaceutical Sciences*, 19$^{th}$ Ed., Mack Publishing Company, Easton, Pa., 1995.

In several embodiments, the compositions include an adjuvant. The person of ordinary skill in the art is familiar with adjuvants, for example, those that can be included in an immunogenic composition. In several embodiments, the adjuvant is selected to elicit a Th1 biased immune response in a subject administered an immunogenic composition containing the adjuvant and a disclosed antigens, or a nucleic acid or a viral vector encoding, expressing or including the antigen.

One suitable adjuvant is a non-toxic bacterial lipopolysaccharide derivative. An example of a suitable non-toxic derivative of lipid A, is monophosphoryl lipid A or more particularly 3-Deacylated monophosphoryl lipid A (3D-MPL). See, for example, U.S. Pat. Nos. 4,436,727; 4,877,611; 4,866,034 and 4,912,094. 3D-MPL primarily promotes CD4+ T cell responses with an IFN-y (Th1) phenotype. 3D-MPL can be produced according to the methods disclosed in GB2220211 A. Chemically it is a mixture of 3-deacylated monophosphoryl lipid A with 3, 4, 5 or 6 acylated chains. In the compositions, small particle 3D-MPL can be used. Small particle 3D-MPL has a particle size such that it can be sterile-filtered through a 0.22 µm filter. Such preparations are described in WO94/21292.

In other embodiments, the lipopolysaccharide can be a β(1-6) glucosamine disaccharide, as described in U.S. Pat. No. 6,005,099 and EP Patent No. 0 729 473 B1. One of skill in the art would be readily able to produce various lipopolysaccharides, such as 3D-MPL, based on the teachings of these references. In addition to the aforementioned immunostimulants (that are similar in structure to that of LPS or MPL or 3D-MPL), acylated monosaccharide and disaccharide derivatives that are a sub-portion to the above structure of MPL are also suitable adjuvants.

In several embodiments, a Toll-like receptor (TLR) agonist is used as an adjuvant. For example a disclosed PreF antigen can be combined with a TLR agonist in an immunogenic composition used for elicitation of a neutralizing immune response to RSV. For example, the TLR agonist can be a TLR-4 agonist such as a synthetic derivative of lipid A (see, e.g., WO 95/14026, and WO 01/46127) an alkyl Glucosaminide phosphate (AGP; see, e.g., WO 98/50399 or U.S. Pat. Nos. 6,303,347; 6,764,840). Other suitable TLR-4 ligands, capable of causing a signaling response through TLR-4 are, for example, lipopolysaccharide from gram-negative bacteria and its derivatives, or fragments thereof, in particular a non-toxic derivative of LPS (such as 3D-MPL). Other suitable TLR agonists are: heat shock protein (HSP) 10, 60, 65, 70, 75 or 90; surfactant Protein A, hyaluronan oligosaccharides, heparan sulphate fragments, fibronectin fragments, fibrinogen peptides and β-defensin-2, and muramyl dipeptide (MDP). In one embodiment the TLR agonist is HSP 60, 70 or 90. Other suitable TLR-4 ligands are as described in WO 2003/011223 and in WO 2003/099195.

Additional TLR agonists (such as an agent that is capable of causing a signaling response through a TLR signaling pathway) are also useful as adjuvants, such as agonists for TLR2, TLR3, TLR7, TLR8 and/or TLR9. Accordingly, in one embodiment, the composition further includes an adjuvant which is selected from the group consisting of: a TLR-1 agonist, a TLR-2 agonist, TLR-3 agonist, a TLR-4 agonist, TLR-5 agonist, a TLR-6 agonist, TLR-7 agonist, a TLR-8 agonist, TLR-9 agonist, or a combination thereof.

In one embodiment, a TLR agonist is used that is capable of causing a signaling response through TLR-1, for example one or more of from: Tri-acylated lipopeptides (LPs); phenol-soluble modulin; *Mycobacterium tuberculosis* LP; S-(2,3-bis(palmitoyloxy)-(2-RS)-propyl)-N-palmitoyl-(R)-Cys-(S)-Ser-(S)-L-ys(4)-OH, trihydrochloride (Pam3Cys) LP which mimics the acetylated amino terminus of a bacterial lipoprotein and OspA LP from *Borrelia burgdorferi*. In another embodiment, a TLR agonist is used that is capable of causing a signaling response through TLR-2, such as one or more of a lipoprotein, a peptidoglycan, a bacterial lipopeptide from *M. tuberculosis, B. burgdorferi* or *T. pallidum*; peptidoglycans from species including *Staphylococcus*

*aureus*; lipoteichoic acids, mannuronic acids, *Neisseria porins*, bacterial fimbriae, Yersina virulence factors, CMV virions, measles haemagglutinin, and zymosan from yeast. In some embodiments, a TLR agonist is used that is capable of causing a signaling response through TLR-3, such as one or more of double stranded RNA (dsRNA), or polyinosinic-polycytidylic acid (Poly IC), a molecular nucleic acid pattern associated with viral infection. In further embodiments, a TLR agonist is used that is capable of causing a signaling response through TLR-5, such as bacterial flagellin. In additional embodiments, a TLR agonist is used that is capable of causing a signaling response through TLR-6, such as one or more of mycobacterial lipoprotein, di-acylated LP, and phenol-soluble modulin. Additional TLR6 agonists are described in WO 2003/043572. In an embodiment, a TLR agonist is used that is capable of causing a signaling response through TLR-7, such as one or more of a single stranded RNA (ssRNA), loxoribine, a guanosine analogue at positions N7 and C8, or an imidazoquinoline compound, or derivative thereof. In one embodiment, the TLR agonist is imiquimod. Further TLR7 agonists are described in WO 2002/085905. In some embodiments, a TLR agonist is used that is capable of causing a signaling response through TLR-8. Suitably, the TLR agonist capable of causing a signaling response through TLR-8 is a single stranded RNA (ssRNA), an imidazoquinoline molecule with anti-viral activity, for example resiquimod (R848); resiquimod is also capable of recognition by TLR-7. Other TLR-8 agonists which can be used include those described in WO 2004/071459.

In further embodiments, an adjuvant includes a TLR agonist capable of inducing a signaling response through TLR-9. For example, the adjuvant can include HSP90, bacterial or viral DNA, and/or DNA containing unmethylated CpG nucleotides (e.g., a CpG oligonucleotide). For example, CpG-containing oligonucleotides induce a predominantly Th1 response. Such oligonucleotides are well known and are described, for example, in WO 95/26204, WO 96/02555, WO 99/33488 and U.S. Pat. Nos. 5,278,302, 5,666,153, and. 6,008,200 and 5,856,462. Accordingly, oligonucleotides for use as adjuvants in the disclosed compositions include CpG containing oligonucleotides, for example, containing two or more dinucleotide CpG motifs. Also included are oligonucleotides with mixed internucleotide linkages.

Other adjuvants that can be used in immunogenic compositions with the antigens, or a nucleic acid or a viral vector encoding, expressing or including an antigen, e.g., on their own or in combination with 3D-MPL, or another adjuvant described herein, are saponins, such as QS21. In some examples, saponins are used as an adjuvant, e.g., for systemic administration of a PreF antigen. Use of saponins (e.g., use of Quil A, derived from the bark of the South American tree Quillaja *Saponaria Molina*) as adjuvants is familiar to the person of ordinary skill in the art (see, e.g., U.S. Pat. No. 5,057,540 and EP 0 362 279 B1. EP 0 109 942 B1; WO 96/11711; WO 96/33739). The haemolytic saponins QS21 and QS17 (HPLC purified fractions of Quil A) have been described as potent systemic adjuvants, and the method of their production is disclosed in U.S. Pat. No. 5,057,540 and EP 0 362 279 B1.

The adjuvant can also include mineral salts such as an aluminum or calcium salts, in particular aluminum hydroxide, aluminum phosphate and calcium phosphate.

Another class of suitable Th1 biasing adjuvants for use in compositions includes outer membrane proteins (OMP)-based immunostimulatory compositions. OMP-based immunostimulatory compositions are particularly suitable as mucosal adjuvants, e.g., for intranasal administration. OMP-based immunostimulatory compositions are a genus of preparations of (OMPs, including some porins) from Gram-negative bacteria, e.g., *Neisseria* species, which are useful as a carrier or in compositions for immunogens, such as bacterial or viral antigens (see, e.g., U.S. Pat. No. 5,726,292; U.S. Pat. No. 4,707,543). Further, proteosomes have the capability to auto-assemble into vesicle or vesicle-like OMP clusters of about 20 nm to about 800 nm, and to noncovalently incorporate, coordinate, associate (e.g., electrostatically or hydrophobically), or otherwise cooperate with protein antigens (Ags), particularly antigens that have a hydrophobic moiety. Proteosomes can be prepared, for example, as described in the art (see, e.g., U.S. Pat. No. 5,726,292 or U.S. Pat. No. 5,985,284; 2003/0044425.).

Proteosomes are composed primarily of chemically extracted outer membrane proteins (OMPs) from *Neisseria meningitidis* (mostly porins A and B as well as class 4 OMP), maintained in solution by detergent (Lowell G H. Proteosomes for Improved Nasal, Oral, or Injectable Vaccines. In: Levine M M, Woodrow G C, Kaper J B, Cobon G S, eds, New Generation Vaccines. New York: Marcel Dekker, Inc. 1997; 193-206). Proteosomes can be formulated with a variety of antigens such as purified or recombinant proteins derived from viral sources, including the PreF polypeptides disclosed herein. The gradual removal of detergent allows the formation of particulate hydrophobic complexes of approximately 100-200 nm in diameter (Lowell G H. Proteosomes for Improved Nasal, Oral, or Injectable Vaccines. In: Levine M M, Woodrow G C, Kaper J B, Cobon G S, eds, New Generation Vaccines. New York: Marcel Dekker, Inc. 1997; 193-206).

Combinations of different adjuvants can also be used in compositions with the disclosed PreF antigens, viral vectors, or nucleic acid molecules in the composition. For example, as already noted, QS21 can be formulated together with 3D-MPL. The ratio of QS21:3D-MPL will typically be in the order of 1:10 to 10:1; such as 1:5 to 5:1, and often substantially 1:1. Typically, the ratio is in the range of 2.5:1 to 1:1 3D-MPL:QS21 (such as AS01 (GlaxoSmithKline). Another combination adjuvant formulation includes 3D-MPL and an aluminum salt, such as aluminum hydroxide (such as AS04 (GlaxoSmithKline) When formulated in combination, this combination can enhance an antigen-specific Th1 immune response.

In some instances, the adjuvant formulation a mineral salt, such as a calcium or aluminum (alum) salt, for example calcium phosphate, aluminum phosphate or aluminum hydroxide. In some embodiments, the adjuvant includes an oil and water emulsion, e.g., an oil-in-water emulsion (such as MF59 (Novartis) or AS03 (GlaxoSmithKline). One example of an oil-in-water emulsion comprises a metabolisable oil, such as squalene, a tocol such as a tocopherol, e.g., alpha-tocopherol, and a surfactant, such as sorbitan trioleate (Span 85) or polyoxyethylene sorbitan monoleate (Tween 80), in an aqueous carrier.

The pharmaceutical composition typically contains a therapeutically effective amount of a disclosed PreF antigen, viral vector, or nucleic acid molecule and can be prepared by conventional techniques. Preparation of immunogenic compositions, including those for administration to human subjects, is generally described in Pharmaceutical Biotechnology, Vol. 61 Vaccine Design—the subunit and adjuvant approach, edited by Powell and Newman, Plenum Press, 1995. New Trends and Developments in Vaccines, edited by Voller et al., University Park Press, Baltimore, Md., U.S.A.

1978. Encapsulation within liposomes is described, for example, by Fullerton, U.S. Pat. No. 4,235,877. Conjugation of proteins to macromolecules is disclosed, for example, by Likhite, U.S. Pat. No. 4,372,945 and by Armor et al., U.S. Pat. No. 4,474,757. Typically, the amount of antigen in each dose of the immunogenic composition is selected as an amount which induces an immune response without significant, adverse side effects.

The amount of the disclosed PreF antigen, viral vector, or nucleic acid molecule can vary depending upon the specific antigen employed, the route and protocol of administration, and the target population, for example. Typically, each human dose will comprise 1-1000 µg of protein, such as from about 1 µg to about 100 µg, for example, from about 1 µg to about 50 µg, such as about 1 µg, about 2 µg, about 5 µg, about 10 µg, about 15 µg, about 20 µg, about 25 µg, about 30 µg, about 40 µg, or about 50 µg. The amount utilized in an immunogenic composition is selected based on the subject population (e.g., infant or elderly). An optimal amount for a particular composition can be ascertained by standard studies involving observation of antibody titers and other responses in subjects. It is understood that a therapeutically effective amount of an antigen in a immunogenic composition can include an amount that is ineffective at eliciting an immune response by administration of a single dose, but that is effective upon administration of multiple dosages, for example in a prime-boost administration protocol.

In several examples, pharmaceutical compositions for eliciting an immune response against RSV in humans include a therapeutically effective amount of a disclosed PreF antigens, viral vectors, or nucleic acid molecules for administration to infants (e.g., infants between birth and 1 year, such as between 0 and 6 months, at the age of initial dose) or elderly patients subject (such as a subject greater than 65 years of age). It will be appreciated that the choice of adjuvant can be different in these different applications, and the optimal adjuvant and concentration for each situation can be determined empirically by those of skill in the art.

In certain embodiments, the pharmaceutical compositions are vaccines that reduce or prevent infection with RSV. In some embodiments, the immunogenic compositions are vaccines that reduce or prevent a pathological response following infection with RSV. Optionally, the pharmaceutical compositions containing the disclosed PreF antigen, viral vector, or nucleic acid molecule are formulated with at least one additional antigen of a pathogenic organism other than RSV. For example, the pathogenic organism can be a pathogen of the respiratory tract (such as a virus or bacterium that causes a respiratory infection). In certain cases, the pharmaceutical composition contains an antigen derived from a pathogenic virus other than RSV, such as a virus that causes an infection of the respiratory tract, such as influenza or parainfluenza. In other embodiments, the additional antigens are selected to facilitate administration or reduce the number of inoculations required to protect a subject against a plurality of infectious organisms. For example, the antigen can be derived from any one or more of influenza, hepatitis B, diphtheria, tetanus, pertussis, Hemophilus influenza, poliovirus, *Streptococcus* or *Pneumococcus*, among others.

F. Methods of Treatment

In several embodiments, the disclosed PreF antigens, or a nucleic acid or a viral vector encoding, expressing or including a PreF antigen are used to induce an immune response to RSV in a subject. Thus, in several embodiments, a therapeutically effective amount of an immunogenic composition including one or more of the disclosed PreF antigens, or a nucleic acid or a viral vector encoding, expressing or including the antigen, can be administered to a subject in order to generate an immune response to RSV.

In accordance with the disclosure herein, a prophylactically or therapeutically effective amount of a immunogenic composition including a PreF antigen, or a nucleic acid or a viral vector encoding, expressing or including the antigen, is administered to a subject in need of such treatment for a time and under conditions sufficient to prevent, inhibit, and/or ameliorate a RSV infection in a subject. The immunogenic composition is administered in an amount sufficient to elicit an immune response against an RSV antigen, such as RSV F protein, in the subject.

In some embodiments, the composition administered to the subject includes (or encodes) a first recombinant RSV F protein that is a subtype A RSV F protein stabilized in a prefusion conformation, and a second recombinant RSV F protein that is a subtype B RSV F protein stabilized in a prefusion conformation. In several embodiments, the composition administered to the subject includes a mixture (such as about a 1:1, 1:2, 2:1, 2:3, 3:2, 1:3, 3:1, 1:4, 4:1, 3:5, 5:3, 1:5, 5:1, 5:7, 7:5 mixture), of a first recombinant RSV F protein that is a subtype A RSV F protein stabilized in a prefusion conformation, and a second recombinant RSV F protein that is a subtype B RSV F protein stabilized in a prefusion conformation.

In some embodiments the composition administered to the subject includes a first protein nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second protein nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments the composition administered to the subject includes a first nucleic acid molecule (such as an expression vector) encoding a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second nucleic acid molecule (such as an expression vector) including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein.

In some embodiments, a composition including ferritin nanoparticles including the recombinant RSV F protein stabilized in a prefusion conformation by any of the substitutions disclosed herein (such as S155C, S290C, and S190F substitutions or S155C, S290C, S190F, and V207L substitutions) is administered to a subject. In some embodiments the composition administered to the subject includes a first ferritin nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype A RSV F protein, and a second ferritin nanoparticle including a recombinant RSV F protein stabilized in a prefusion conformation by any of the substitutions disclosed herein (such as S155C, S290C, and S190F substitutions or S155C, S290C, S190F, and V207L substitutions), wherein the stabilized RSV F protein is based on a subtype B RSV F protein. Methods of making ferritin nanoparticles including a viral antigen and their use for immunization purposes (e.g., for immunization against influenza antigens) have been disclosed in the art (see, e.g., Kanekiyo et al., Nature, 499:102-106, 2013, incorporated by reference herein in its entirety).

In some embodiments, a subject is selected for treatment that has, or is at risk for developing, an RSV infection, for example, because of exposure or the possibility of exposure to RSV. Following administration of a therapeutically effective amount of the disclosed therapeutic compositions, the subject can be monitored for RSV infection, symptoms associated with RSV infection, or both. Because nearly all humans are infected with RSV by the age of 3, the entire birth cohort is included as a relevant population for immunization. This could be done, for example, by beginning an immunization regimen anytime from birth to 6 months of age, from 6 months of age to 5 years of age, in pregnant women (or women of child-bearing age) to protect their infants by passive transfer of antibody, family members of newborn infants or those still in utero, and subjects greater than 50 years of age.

Subjects at greatest risk of RSV infection with severe symptoms (e.g. requiring hospitalization) include children with prematurity, bronchopulmonary dysplasia, and congenital heart disease are most susceptible to severe disease. Atopy or a family history of atopy has also been associated with severe disease in infancy. During childhood and adulthood, disease is milder but can be associated with lower airway disease and is commonly complicated by sinusitis. Disease severity increases in the institutionalized elderly (e.g., humans over 65 years old). Severe disease also occurs in persons with severe combined immunodeficiency disease or following bone marrow or lung transplantation. (See, e.g., Shay et al., JAMA, 282:1440-6, 1999; Hall et al., N Engl J Med. 2009; 360:588-598; Glezen et al., *Am J Dis Child.*, 1986; 140:543-546; and Graham, Immunol. Rev., 239:149-166, 2011, each of which is incorporated by reference herein). Thus, these subjects can be selected for administration of the disclosed PreF antigens, or a nucleic acid or a viral vector encoding, expressing or including a PreF antigen.

Typical subjects intended for treatment with the compositions and methods of the present disclosure include humans, as well as non-human primates and other animals, such as cattle. To identify subjects for prophylaxis or treatment according to the methods of the disclosure, screening methods employed to determine risk factors associated with a targeted or suspected disease or condition, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods, which are available and well known in the art to detect and/or characterize RSV infection. These and other routine methods allow the clinician to select patients in need of therapy using the methods and pharmaceutical compositions of the disclosure. An immunogenic composition can be administered as an independent prophylaxis or treatment program, or as a follow-up, adjunct or coordinate treatment regimen to other treatments.

The immunogenic composition can be used in coordinate vaccination protocols or combinatorial formulations. In certain embodiments, combinatorial immunogenic compositions and coordinate immunization protocols employ separate immunogens or formulations, each directed toward eliciting an immune response to an RSV antigen, such as an immune response to RSV F protein. Separate immunogenic compositions that elicit the immune response to the RSV antigen can be combined in a polyvalent immunogenic composition administered to a subject in a single immunization step, or they can be administered separately (in monovalent immunogenic compositions) in a coordinate immunization protocol.

The administration of the immunogenic compositions can be for either prophylactic or therapeutic purpose. When provided prophylactically, the immunogenic composition is provided in advance of any symptom, for example in advance of infection. The prophylactic administration of the immunogenic compositions serves to prevent or ameliorate any subsequent infection. When provided therapeutically, the immunogenic composition is provided at or after the onset of a symptom of disease or infection, for example after development of a symptom of RSV infection, or after diagnosis of RSV infection. The immunogenic composition can thus be provided prior to the anticipated exposure to RSV so as to attenuate the anticipated severity, duration or extent of an infection and/or associated disease symptoms, after exposure or suspected exposure to the virus, or after the actual initiation of an infection.

Administration induces a sufficient immune response to treat or prevent the pathogenic infection, for example, to inhibit the infection and/or reduce the signs and/or symptoms of the infection. Amounts effective for this use will depend upon the severity of the disease, the general state of the subject's health, and the robustness of the subject's immune system. A therapeutically effective amount of the disclosed immunogenic compositions is that which provides either subjective relief of a symptom(s) or an objectively identifiable improvement as noted by the clinician or other qualified observer.

For prophylactic and therapeutic purposes, the immunogenic composition can be administered to the subject in a single bolus delivery, via continuous delivery (for example, continuous transdermal, mucosal or intravenous delivery) over an extended time period, or in a repeated administration protocol (for example, by an hourly, daily or weekly, repeated administration protocol). The therapeutically effective dosage of the immunogenic composition can be provided as repeated doses within a prolonged prophylaxis or treatment regimen that will yield clinically significant results to alleviate one or more symptoms or detectable conditions associated with a targeted disease or condition as set forth herein. Determination of effective dosages in this context is typically based on animal model studies followed up by human clinical trials and is guided by administration protocols that significantly reduce the occurrence or severity of targeted disease symptoms or conditions in the subject. Suitable models in this regard include, for example, murine, rat, porcine, feline, ferret, non-human primate, and other accepted animal model subjects known in the art. Alternatively, effective dosages can be determined using in vitro models (for example, immunologic and histopathologic assays). Using such models, only ordinary calculations and adjustments are required to determine an appropriate concentration and dose to administer a therapeutically effective amount of the immunogenic composition (for example, amounts that are effective to elicit a desired immune response or alleviate one or more symptoms of a targeted disease). In alternative embodiments, an effective amount or effective dose of the immunogenic composition may simply inhibit or enhance one or more selected biological activities correlated with a disease or condition, as set forth herein, for either therapeutic or diagnostic purposes.

In one embodiment, a suitable immunization regimen includes at least three separate inoculations with one or more immunogenic compositions, with a second inoculation being administered more than about two, about three to eight, or about four, weeks following the first inoculation. Generally, the third inoculation is administered several months after the second inoculation, and in specific embodiments, more than about five months after the first inoculation, more than about six months to about two years after the first inoculation, or about eight months to about one year after the first inoculation. Periodic inoculations beyond the third are also desirable to enhance the subject's "immune memory." The adequacy of the vaccination parameters chosen, e.g., formulation, dose, regimen and the like, can be determined by taking aliquots of serum from the subject and assaying antibody titers during the course of the immunization program. If such monitoring indicates that vaccination is sub-optimal, the subject can be boosted with an additional dose of immunogenic composition, and the vaccination parameters can be modified in a fashion expected to potentiate the immune response. It is contemplated that there can be several boosts, and that each boost can include the same or a different PreF antigen.

For prime-boost protocols, the prime can be administered as a single dose or multiple doses, for example two doses, three doses, four doses, five doses, six doses or more can be administered to a subject over days, weeks or months. The boost can be administered as a single dose or multiple doses, for example two to six doses, or more can be administered to a subject over a day, a week or months. Multiple boosts can also be given, such one to five, or more. Different dosages can be used in a series of sequential inoculations. For example a relatively large dose in a primary inoculation and then a boost with relatively smaller doses. The immune response against the selected antigenic surface can be generated by one or more inoculations of a subject with an immunogenic composition disclosed herein.

In some embodiments, the prime composition administered to the subject includes (or encodes) a recombinant RSV F protein that is a subtype A RSV F protein stabilized in a prefusion conformation, and the boost composition administered to the subject includes (or encodes) a recombinant RSV F protein that is a subtype B RSV F protein stabilized in a prefusion conformation. In some embodiments, the prime composition administered to the subject includes (or encodes) a recombinant RSV F protein that is a subtype B RSV F protein stabilized in a prefusion conformation, and the boost composition administered to the subject includes (or encodes) a recombinant RSV F protein that is a subtype A RSV F protein stabilized in a prefusion conformation.

In some embodiments, the methods include administering a composition including a recombinant subtype A RSV F protein stabilized in a prefusion conformation and a recombinant subtype B RSV F protein stabilized in a prefusion conformation, once, or more than one (such as in a prime-boost protocol) as a series of injections.

In some embodiments, the methods include administering a composition including a ferritin nanoparticle including a recombinant subtype A RSV F protein stabilized in a prefusion conformation and ferritin nanoparticle including a recombinant subtype B RSV F protein stabilized in a prefusion conformation, once, or more than one (such as in a prime-boost protocol) as a series of injections.

In some embodiments, the methods include administering a composition including a vector encoding a recombinant subtype A RSV F protein stabilized in a prefusion conformation and vector encoding a recombinant subtype B RSV F protein stabilized in a prefusion conformation, once, or more than one (such as in a prime-boost protocol) as a series of injections. In some embodiments, the method can further include administration of a composition including recombinant subtype A RSV F protein stabilized in a prefusion conformation and recombinant subtype B RSV F protein stabilized in a prefusion conformation, and/or a composition including a ferritin nanoparticle including a recombinant subtype A RSV F protein stabilized in a prefusion conformation and ferritin nanoparticle including a recombinant subtype B RSV F protein stabilized in a prefusion conformation.

In some embodiments, the methods include administering a composition including a nucleic acid molecule encoding a recombinant subtype A RSV F protein stabilized in a prefusion conformation and nucleic acid molecule encoding a recombinant subtype B RSV F protein stabilized in a prefusion conformation once, or more than one (such as in a prime-boost protocol) as a series of injections. In some embodiments, the method can further include administration of a composition including recombinant subtype A RSV F protein stabilized in a prefusion conformation and recombinant subtype B RSV F protein stabilized in a prefusion conformation, and/or a composition including a ferritin nanoparticle including a recombinant subtype A RSV F protein stabilized in a prefusion conformation and ferritin nanoparticle including a recombinant subtype B RSV F protein stabilized in a prefusion conformation.

In some embodiments, the prime and boost compositions administered to the subject each include (or encode) a first recombinant RSV F protein that is a subtype A RSV F protein stabilized in a prefusion conformation, and a second recombinant RSV F protein that is a subtype B RSV F protein stabilized in a prefusion conformation. In several embodiments, the prime and boost compositions administered to the subject each include (or encode) a mixture (such as about a 1:1, 1:2, 2:1, 2:3, 3:2, 1:3, 3:1, 1:4, 4:1, 3:5, 5:3, 1:5, 5:1, 5:7, 7:5 mixture), of a first recombinant RSV F protein that is a subtype A RSV F protein stabilized in a prefusion conformation, and a second recombinant RSV F protein that is a subtype B RSV F protein stabilized in a prefusion conformation.

In some embodiments the prime and boost compositions administered to the subject each include a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a second recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions).

In some embodiments the prime and boost compositions administered to the subject each include a nucleic acid molecule encoding a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a nucleic acid molecule encoding a recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions).

In some embodiments the prime and boost compositions administered to the subject each include a first protein nanoparticle (such as a ferritin nanoparticle) including a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a second protein nanoparticle (such as a ferritin nanoparticle) including a recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions).

In some embodiments the prime and boost compositions administered to the subject each include a vector including or encoding a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a vector including or encoding a recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions).

In some embodiments the prime composition administered to the subject includes a first nucleic acid molecule (such as a DNA plasmid expression vector) encoding a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a second nucleic acid molecule (such as an expression vector) including a recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions), and the boost composition administered to the subject includes a first protein nanoparticle (such as a ferritin nanoparticle) including a recombinant RSV F protein that is a subtype A RSV F protein stabilized in a prefusion conformation by any of the substitutions disclosed herein (such as S155C, S290C, and S190F substitutions or S155C, S290C, S190F, and V207L substitutions), and a second protein nanoparticle (such as a ferritin nanoparticle) including a recombinant RSV F protein that is a subtype B RSV F protein stabilized in a prefusion conformation by any of the substitutions disclosed herein (such as S155C, S290C, and S190F substitutions or S155C, S290C, S190F, and V207L substitutions).

Immunization protocols using a DNA plasmid prime and ferritin nanoparticle boost are known to the person of ordinary skill in the art (see, e.g., Wei et al., Science, 329(5995):1060-4, 2010, which is incorporated by reference herein in its entirety).

The actual dosage of the immunogenic composition will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the immunogenic composition for eliciting the desired activity or biological response in the subject. Dosage regimens can be adjusted to provide an optimum prophylactic or therapeutic response. As described above in the forgoing listing of terms, an effective amount is also one in which any toxic or detrimental side effects of the disclosed antigen and/or other biologically active agent is outweighed in clinical terms by therapeutically beneficial effects.

A non-limiting range for a therapeutically effective amount of the disclosed PreF antigens within the methods and immunogenic compositions of the disclosure is about 0.0001 mg/kg body weight to about 10 mg/kg body weight, such as about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.5 mg/kg, about 2 mg/kg, about 2.5 mg/kg, about 3 mg/kg, about 4 mg/kg, about 5 mg/kg, or about 10 mg/kg, for example 0.01 mg/kg to about 1 mg/kg body weight, about 0.05 mg/kg to about 5 mg/kg body weight, about 0.2 mg/kg to about 2 mg/kg body weight, or about 1.0 mg/kg to about 10 mg/kg body weight.

In some embodiments, the dosage a set amount of a disclosed PreF antigen, or a nucleic acid or a viral vector encoding, expressing or including a PreF antigen includes for children, adults, elderly, etc., such as from about 1-300 µg, for example, a dosage of about 1, 2, 3, 4, 5, 6, 7, 8, 9, 10, 15, 20, 30, 40, 50, 60, 70, 80, 90, 100, 150, 200, 250, or about 300 µg of the PreF antigens, or a nucleic acid or a viral vector encoding, expressing or including a PreF antigen. The dosage and number of doses will depend on the setting, for example, in an adult or anyone primed by prior RSV infection or immunization, a single dose may be a sufficient booster. In naïve infants, in some examples, at least two doses would be given, for example, at least three doses. In some embodiments, an annual boost is given to elderly subjects (e.g., humans over age 60) once per year, for example, along with an annual influenza vaccination. Methods for preparing administrable compositions will be known or apparent to those skilled in the art and are described in more detail in such publications as *Remingtons Pharmaceutical Sciences*, 19$^{th}$ Ed., Mack Publishing Company, Easton, Pa., 1995.

Dosage can be varied by the attending clinician to maintain a desired concentration at a target site (for example, systemic circulation). Higher or lower concentrations can be selected based on the mode of delivery, for example, transepidermal, rectal, oral, pulmonary, or intranasal delivery versus intravenous or subcutaneous delivery. Dosage can also be adjusted based on the release rate of the administered formulation, for example, of an intrapulmonary spray versus powder, sustained release oral versus injected particulate or transdermal delivery formulations, and so forth. To achieve the same serum concentration level, for example, slow-release particles with a release rate of 5 nanomolar (under standard conditions) would be administered at about twice the dosage of particles with a release rate of 10 nanomolar.

Upon administration of an immunogenic composition of this disclosure, the immune system of the subject typically responds to the immunogenic composition by producing antibodies specific for the prefusion conformation of the RSV F protein. Such a response signifies that an effective dose of the immunogenic composition was delivered.

In several embodiments, it may be advantageous to administer the immunogenic compositions disclosed herein with other agents such as proteins, peptides, antibodies, and other antiviral agents, such as anti-RSV agents. Non-limiting examples of anti-RSV agents include the monoclonal antibody palivizumab (SYNAGIS®; Medimmune, Inc.) and the small molecule anti-viral drug ribavirin (manufactured by many sources, e.g., Warrick Pharmaceuticals, Inc.). In certain embodiments, immunogenic compositions are administered concurrently with other anti-RSV agents. In certain embodiments, the immunogenic compositions are administered sequentially with other anti-RSV therapeutic agents, such as before or after the other agent. One of ordinary skill in the art would know that sequential administration can mean immediately following or after an appropriate period of time, such as hours, days, weeks, months, or even years later.

In additional embodiments, a therapeutically effective amount of a pharmaceutical composition including a nucleic acid encoding a disclosed PreF antigen is administered to a subject in order to generate an immune response. In one specific, non-limiting example, a therapeutically effective amount of a nucleic acid encoding a disclosed antigen is administered to a subject to treat or prevent or inhibit RSV infection.

One approach to administration of nucleic acids is direct immunization with plasmid DNA, such as with a mammalian expression plasmid. As described above, the nucleotide sequence encoding a disclosed antigen can be placed under the control of a promoter to increase expression of the molecule. Another approach would use RNA (such as Non-viral delivery of self-amplifying RNA vaccines, see e.g., Geall et al., Proc Natl Acad Sci USA, 109:14604-9, 2012.

Immunization by nucleic acid constructs is well known in the art and taught, for example, in U.S. Pat. No. 5,643,578 (which describes methods of immunizing vertebrates by introducing DNA encoding a desired antigen to elicit a cell-mediated or a humoral response), and U.S. Pat. No. 5,593,972 and U.S. Pat. No. 5,817,637 (which describe operably linking a nucleic acid sequence encoding an antigen to regulatory sequences enabling expression). U.S. Pat. No. 5,880,103 describes several methods of delivery of nucleic acids encoding immunogenic peptides or other antigens to an organism. The methods include liposomal delivery of the nucleic acids (or of the synthetic peptides themselves), and immune-stimulating constructs, or ISCOMS™, negatively charged cage-like structures of 30-40 nm in size formed spontaneously on mixing cholesterol and Quil A™ (saponin). Protective immunity has been generated in a variety of experimental models of infection, including toxoplasmosis and Epstein-Barr virus-induced tumors, using ISCOMS™ as the delivery vehicle for antigens (Mowat and Donachie, *Immunol. Today* 12:383, 1991). Doses of antigen as low as 1 µg encapsulated in ISCOMS™ have been found to produce Class I mediated CTL responses (Takahashi et al., *Nature* 344:873, 1990).

In another approach to using nucleic acids for immunization, a disclosed antigen can also be expressed by attenuated viral hosts or vectors or bacterial vectors. Recombinant vaccinia virus, adenovirus, adeno-associated virus (AAV), herpes virus, retrovirus, cytomegalovirus or other viral vectors can be used to express the peptide or protein, thereby eliciting a CTL response. For example, vaccinia vectors and methods useful in immunization protocols are described in U.S. Pat. No. 4,722,848. BCG (*Bacillus* Calmette Guerin) provides another vector for expression of the peptides (see Stover, *Nature* 351:456-460, 1991).

In one embodiment, a nucleic acid encoding a disclosed PreF antigen is introduced directly into cells. For example, the nucleic acid can be loaded onto gold microspheres by standard methods and introduced into the skin by a device such as Bio-Rad's HELIOS™ Gene Gun. The nucleic acids can be "naked," consisting of plasmids under control of a strong promoter. Typically, the DNA is injected into muscle, although it can also be injected directly into other sites, including tissues in proximity to metastases. Dosages for injection are usually around 0.5 µg/kg to about 50 mg/kg, and typically are about 0.005 mg/kg to about 5 mg/kg (see, e.g., U.S. Pat. No. 5,589,466).

In addition to the therapeutic methods provided above, any of the disclosed PreF antigens can be utilized to produce antigen specific immunodiagnostic reagents, for example, for serosurveillance. Immunodiagnostic reagents can be designed from any of the antigens described herein. For example, in the case of the disclosed antigens, the presence of serum antibodies to RSV is monitored using the isolated antigens disclosed herein, such as to detect an RSV infection and/or the presence of antibodies that specifically bind to the prefusion conformation of RSV F protein.

Generally, the method includes contacting a sample from a subject, such as, but not limited to a blood, serum, plasma, urine or sputum sample from the subject with one or more of the RSV F protein antigen stabilized in a prefusion conformation disclosed herein and detecting binding of antibodies in the sample to the disclosed immunogens. The binding can be detected by any means known to one of skill in the art, including the use of labeled secondary antibodies that specifically bind the antibodies from the sample. Labels include radiolabels, enzymatic labels, and fluorescent labels.

In addition, the detection of the prefusion RSV F binding antibody also allows the response of the subject to immunization with the disclosed antigen to be monitored. In still other embodiments, the titer of the prefusion RSV F antibody binding antibodies is determined. The binding can be detected by any means known to one of skill in the art, including the use of labeled secondary antibodies that specifically bind the antibodies from the sample. Labels include radiolabels, enzymatic labels, and fluorescent labels. In other embodiments, a disclosed immunogen is used to isolate antibodies present in a subject or biological sample obtained from a subject.

G. Kits

Kits are also provided. For example, kits for treating or preventing an RSV infection in a subject, or for detecting the presence of RSV F protein prefusion specific antibodies in the sera of a subject. The kits will typically include one or more of the PreF antigens, or a nucleic acid or a viral vector encoding, expressing or including the antigen.

The kit can include a container and a label or package insert on or associated with the container. Suitable containers include, for example, bottles, vials, syringes, etc. The containers may be formed from a variety of materials such as glass or plastic. The container typically holds a composition including one or more of the disclosed PreF antigens, or a nucleic acid or a viral vector encoding, expressing or including the antigen, which is effective for treating or preventing RSV infection. In several embodiments the container may have a sterile access port (for example the container may be an intravenous solution bag or a vial having a stopper pierceable by a hypodermic injection needle). The label or package insert indicates that the composition is used for treating the particular condition.

The label or package insert typically will further include instructions for use of a PreF antigen, or a nucleic acid or a viral vector encoding, expressing or including the antigen, for example, in a method of treating or preventing a RSV infection. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. The kits may additionally include buffers and other reagents routinely used for the practice of a particular method. Such kits and appropriate contents are well known to those of skill in the art.

H. Certain Embodiments

Additional embodiments are disclosed in section H on pages 135-158 of priority U.S. Provisional application No. 61/863,909, filed Aug. 8, 2013, which is specifically incorporated by reference herein in its entirety.

Clause 1. An isolated immunogen, comprising:
a recombinant RSV F protein or fragment thereof comprising at least one amino acid substitution compared to a native RSV F protein that stabilizes the recombinant RSV F protein in a prefusion conformation that specifically binds to a RSV F prefusion specific antibody, and wherein the antibody does not specifically bind to a RSV F protein in a post-fusion conformation.

Clause 2. the immunogen specifically binds to the antibody after incubation at 20° C. in phosphate buffered saline at physiological pH for at least 24 hours in the absence of the antibody.

Clause 3. The immunogen of clause 1 or clause 2, wherein the prefusion conformation of the recombinant RSV F protein or fragment thereof comprises an antigenic site Ø that specifically binds to the prefusion specific antibody, and wherein the antigenic site Ø comprises residues 62-69 and 196-209 of a native RSV F protein sequence set forth as one of SEQ ID NOs: 1-184.

Clause 4. The immunogen of any of clauses 1-3, wherein the immunogen specifically binds to a D25, a AM22, a 5C4, or a MPE8 prefusion specific antibody.

Clause 5. The immunogen of any of clauses 1-4, wherein the native RSV F protein is a human subtype A, human subtype B, or bovine RSV F protein.

Clause 6. The immunogen of any of clauses 1-5, wherein the recombinant RSV F protein or fragment thereof comprises a $F_1$ polypeptide and a $F_2$ polypeptide, and optionally does not comprise a pep27 polypeptide or portion thereof.

Clause 7. The immunogen of clause 6, wherein the $F_2$ and $F_1$ polypeptides comprise RSV F positions 62-69 and 196-209, respectively, and wherein:
the $F_2$ polypeptide comprises or consists of 8-84 residues of RSV F positions 26-109; and
the $F_1$ polypeptides comprises or consists of 14-393 residues of RSV F positions 137-529,
wherein the RSV F positions correspond to the amino acid sequence of a reference $F_0$ polypeptide set forth as SEQ ID NO: 124.

Clause 8. The immunogen of clause 7, wherein the C-terminal residue of the $F_2$ polypeptide and the N-terminal residue of the $F_1$ polypeptide, respectively, comprise RSV F positions 97 and 137; 97 and 145; 97 and 150; 102 and 144; 102 and 145; 102 and 146; 102 and 147; 103 and 144; 103 and 145; 103 and 146; 103 and 147; 104 and 144; 104 and 145; 104 and 146; 104 and 147; 105 and 144; 105 and 145; 105 and 146; 105 and 147; or 105 and 150.

Clause 9. The immunogen of clause 7, wherein the $F_2$ and $F_1$ polypeptides respectively comprise or consist of RSV F positions: 26-109 and 137-513; 26-107 and 137-513; 26-107 and 145-513; 26-105 and 137-513; 26-105 and 145-513; 26-103 and 145-513; 26-109 and 137-529; 26-107 and 137-529; 26-107 and 145-529; 26-105 and 137-529; 26-105 and 145-529; 26-103 and 145-529; 46-103 and 147-310; 46-104 and 146-310; 50-96 and 149-306; 51-103 and 146-307; 51-103 and 139-307; 50-105 and 146-306; or 53-97 and 148 to one of 305-320.

Clause 10. The immunogen of any of the preceding clauses, wherein the recombinant RSV F protein comprises or consists of a $F_2$ polypeptide and a $F_1$ polypeptide comprising amino acid sequences at least 80% identical to amino acids 26-103 and 145-310, respectively, of a native RSV F protein sequence set forth as any one of SEQ ID NOs: 1-184.

Clause 11. The immunogen of any of the preceding clauses, wherein the recombinant RSV F protein comprises or consists of a $F_2$ polypeptide and a $F_1$ polypeptide comprising amino acid sequences at least 80% identical to amino acids 26-103 and 145-310, respectively, of SEQ ID NO: 124.

Clause 12 The immunogen of any of the preceding clauses, wherein the recombinant RSV F protein comprises or consists of a $F_2$ polypeptide and a $F_1$ polypeptide comprising amino acid sequences at least 80% identical to amino acids 26-103 and 145-513, respectively, of SEQ ID NO: 124.

Clause 13. The immunogen of any of the preceding clauses, wherein the recombinant RSV F protein comprises or consists of a $F_2$ polypeptide and a $F_1$ polypeptide comprising amino acid sequences at least 80% identical to amino acids 26-103 and 145-529, respectively, of SEQ ID NO: 124.

Clause 14. The immunogen of any of the preceding clauses, wherein the recombinant RSV F protein comprises or consists of a $F_2$ polypeptide and a $F_1$ polypeptide comprising amino acid sequences at least 80% identical to amino acids 26-103 and 145-551, respectively, of SEQ ID NO: 124.

Clause 15. The immunogen of any of the preceding clauses, wherein the recombinant RSV F protein is a single chain RSV F protein and the $F_2$ and $F_1$ polypeptides are linked by a heterologous peptide linker, or are directly linked.

Clause 16. The immunogen of clause 15, wherein
position 105 of the $F_2$ polypeptide is linked to position 145 of the $F_1$ polypeptide by a Gly-Ser linker; or
position 103 of the $F_2$ polypeptide is directly linked to position 145 of the $F_1$ polypeptide.

Clause 17. The immunogen of clause 16 or clause 16, wherein the heterologous peptide linker comprises the amino acid sequence set forth as one of SEQ ID NOs: 356-365 or 1443-1453, or is a G, S, GG, GS, SG, GGG, or GSG linker.

Clause 18. The isolated immunogen of any one of the previous clauses, wherein the recombinant RSV F protein is stabilized in the RSV F protein prefusion conformation by:
(a) a first disulfide bond between a pair of cysteines;
(b) a cavity-filling amino acid substitution;
(c) a repacking amino acid substitution;
(d) a N-linked glycosylation site;
(e) a combination of two or more of (a)-(d); or
(f) a combination of (a) and (b).

Clause 19. The isolated immunogen of clause 18, wherein the pair of cysteines comprises a first cysteine and a second cysteine, and wherein the first cysteine and the second cysteine are in positions 137-216 of the $F_1$ polypeptide;

the first cysteine and the second cysteine are in positions 461-513 of the $F_1$ polypeptide; or the first cysteine and the second cysteine are in positions 137-216 and 461-513, respectively, of the $F_1$ polypeptide; and wherein the amino acid positions correspond to the amino acid sequence of a reference $F_0$ polypeptide set forth as SEQ ID NO: 124.

Clause 20. The immunogen of clause 18, wherein the first cysteine is introduced by amino acid substitution onto one of RSV F positions 137-216, and the second cysteine is introduced by amino acid substitution onto one of RSV F positions 271-460.

Clause 21. The immunogen of clause 19 or clause 20, wherein the pair of cysteines comprises a first cysteine and a second cysteine, each comprising a Cα carbon and a Cβ carbon, and wherein:

(a) the first cysteine is introduced by amino acid substitution onto one of RSV F positions 137-216 or 461-513, and the second cysteine is introduced by amino acid substitution onto one of RSV F positions 26-61, 77-97, or 271-460; and (b) the Cα carbon of the position of the first cysteine is from 2.0-8.0 angstroms from the Cα carbon of the position of the second cysteine, and/or the Cβ carbon of the position of the first cysteine is from 2.0-5.5 angstroms from the Cβ carbon of the position of the second cysteine using an optimal rotomer for each Cβ carbon, in the three-dimensional structure set forth by the structural coordinates provided in Table 1.

Clause 22. The immunogen of clause 19 or clause 20, wherein the pair of cysteines comprises a first cysteine and a second cysteine, each comprising a Cα carbon and a Cβ carbon, and wherein:

(a) the first cysteine and the second cysteine are introduced by amino acid substitution onto RSV F positions 137-216 or RSV F positions 461-513; or the first cysteine is introduced by amino acid substitution onto RSV F positions 137-216, and the second cysteine is introduced by amino acid substitution onto RSV F positions 461-513; and (b) the Cα carbon of the position of the first cysteine is from 2.0-8.0 angstroms from the Cα carbon of the position of the second cysteine, and/or the Cβ carbon of the position of the first cysteine is from 2.0-5.5 angstroms from the Cβ carbon of the position of the second cysteine using an optimal rotomer for each Cβ carbon, in the three-dimensional structure set forth by the structural coordinates provided in Table 1.

Clause 23. The immunogen of clause 18, wherein the disulfide bond comprises an intra-protomer or an inter-protomer disulfide bond.

Clause 24. The immunogen of clause 23, wherein the non-natural disulfide bond comprises an intra-protomer disulfide bond between RSV F positions 155 and 290; 151 and 288; 137 and 337; 397 and 487; 138 and 353; 341 and 352; 403 and 420; 319 and 413; 401 and 417; 381 and 388; 320 and 415; 319 and 415; 331 and 401; 320 and 335; 406 and 413; 381 and 391; 357 and 371; 403 and 417; 321 and 334; 338 and 394; 288 and 300; 60 and 194; 33 and 469; 54 and 154; 59 and 192; 46 and 311; 48 and 308; or 30 and 410;

an inter-protomer disulfide bond between RSV F positions 400 and 489; 144 and 406; 153 and 461; 149 and 458; 143 and 404; 346 and 454; 399 and 494; 146 and 407; 374 and 454; 369 and 455; 402 and 141; 74 and 218; 183 and 428, and the recombinant RSV F protein comprises a G insertion between positions 182/183; 183 and 428, and the recombinant RSV F protein comprises a C insertion between positions 427/428; 145 and 460, and the recombinant RSV F protein comprises a AA insertion between positions 146/147; 183 and 423, and the recombinant RSV F protein comprises a AAA insertion between positions 182/183; or 330 and 430, and the recombinant RSV F protein comprises a CAA insertion between positions 329/330;

the intra-protomer disulfide bond between RSV F positions 155 and 290, and wherein the recombinant RSV F protein comprises further comprises a non-natural disulfide bond between RSV F positions 74 and 218; 141 and 402; 146 and 460, and a G insertion between positions 460/461; 345 and 454, and a C insertion between positions 453/454; 374 and 454, and a C insertion between positions 453/454; 239 and 279, and a C insertion between positions 238/239; 330 and 493, and a C insertion between positions 329/330; 183 and 428, and a G insertion between positions 182/183; or 183 and 428, and a C insertion between positions 427/428.

Clause 25. The immunogen of clause 23, wherein the recombinant RSV F protein comprises:

the intra-protomer disulfide bond, and one or more of the following sets of substitutions: S155C and S290C; G151C and I288C; F137C and T337C; T397C and E487C; L138C and P353C; W341C and F352C; S403C and T420C; S319C and I413C; D401C and Y417C; L381C and N388C; P320C and S415C; S319C and S415C; N331C and D401C; P320C and T335C; V406C and I413C; L381C and Y391C; T357C and N371C; S403C and Y417C; L321C and L334C; D338C and K394C; I288C and V300C; E60C and D194C; Y33C and V469C; T54C and V154C; I59C and V192C; S46C and T311C; L48C and V308C; E30C and L410C; or the inter-protomer disulfide bond, and one or more of the following sets of substitutions: T400C and D489C; V144C and V406C; A153C and K461C; A149C and Y458C; G143C and S404C; S346C and N454C; K399C and Q494C; S146C and I407C; T374C and N454C; T369C and T455C; or V402C and L141C; A74C and E218C; S155C, S290C, L141C, and V402C; S155C, S290C, A74C, and E218C; N183C and N428C, and a G insertion between positions 182/183; N183C and N427G, and a C insertion between positions 427/428; S145C and 460C; and an AA insertion between positions 146/147; N183C and K423C, and an AAA insertion between positions 182/183; A329C and S430C, and a CAA insertion between positions 329/330; or the intra-protomer disulfide bond between RSV F positions 155 and 290 and the additional non-natural disulfide bond, S155C and S290C substitutions, and one or more of the following sets of amino acid substitutions: S146C, and N460C, and a G insertion between positions 460/461; N345C, and N454G, and a C insertion between positions 453/454; T374C, and N454G, and a C insertion between positions 453/454; S238G, and Q279C, and a C insertion between positions 238/239; and S493C, and a C insertion between positions 329/330; N183C, and N428C; and a G insertion between positions 182/183; or N183C, and N427G; and a C insertion between positions 427/428.

Clause 26. The immunogen of clause 23, wherein the recombinant RSV F protein comprises an $F_1$ polypeptide comprising the amino acid sequence set forth as residues 137-513 of one of SEQ ID NOs: 185, 189, 201, 202, 205, 207, 209, 213, 244, 245, 247, 257-262, 264-275, 277-282, 284, 296-299, 302, 303, 338-340; or an $F_2$ polypeptide and an $F_1$ polypeptide comprising the amino acid sequences set forth as residues 26-109 and 137-513, respectively, of one of SEQ ID NOs: 190, 211, 212, 243, 246, 263, 276, 283, 285.

wherein the amino acid positions correspond to the amino acid sequence of a reference $F_O$ polypeptide set forth as SEQ ID NO: 124.

Clause 27. The immunogen of clause 23, wherein the non-natural disulfide bond comprises an intra-protomer disulfide bond between RSV F positions 155 and 290.

Clause 28. The immunogen of clause 23, wherein the recombinant RSV F protein comprises S155C and S290C substitutions.

Clause 29. The immunogen of clause 23, wherein the recombinant RSV F protein comprises or consists of an amino acid sequence comprising at least 80% identity to residues 26-109 and 137-513, residues 26-103 and 145-513, or residues 26-105 and 145-513, of SEQ ID NOs: 185.

Clause 30. The immunogen of any of clauses 18-29, comprising the cavity-filling amino acid substitution comprising a F, L, W, Y, H, or M substitution at position 190, position 207, or positions 190 and 207.

Clause 31. The immunogen of any of clauses 18-29, comprising the cavity-filling amino acid substitution comprising one of 190F; 190L; 190W; 190Y; 190H; 190M; 190F and 207L; 190F and 207F; 190F and 207W; 190L and 207L; 190L and 207F; 190L and 207W; 190W and 207L; 190W and 207F; 190W and 207W; 190Y and 207L; 190Y and 207F; 190Y and 207W; 190H and 207L; 190H and 207F; 190H and 207W; 190M and 207L; 190M and 207F; 190M and 207W; 207L and 220L; 296F and 190F; 220L and 153W; 203W; 83W and 260W; 58W and 298L; or 87F and 90L.

Clause 32. The immunogen of clause 31, wherein the recombinant RSV F protein comprises positions 137-513 of one of SEQ ID NOs: 191, 193, 196-197 or 248, or 371-376, or positions 26-109 and 137-513 of one of SEQ ID NOs: 192, 195, or 194.

Clause 33. The immunogen of clause 30, wherein the recombinant RSV F protein comprises or consists of an amino acid sequence comprising at least 80% identity to residues 26-109 and 137-513, residues 26-103 and 145-513, or residues 26-105 and 145-513, of SEQ ID NO: 191.

Clause 34. The immunogen of clause 18, wherein the recombinant RSV F protein comprises a non-natural disulfide bond between cysteine substitutions at position 155 and 290, and a cavity filling F, L, W, Y, H, or M substitution at position 190, position 207, or positions 190 and 207.

Clause 35. The immunogen of clause 18, wherein the recombinant RSV F protein comprises S155C, S290C, and S190F substitutions, or S155C, S290C, S190F, and V207L substitutions.

Clause 36. The immunogen of clause 18, wherein the recombinant RSV F protein comprises or consists of an amino acid sequence comprising at least 80% identity to residues 26-109 and 137-513, respectively, or 26-103 and 145-513, respectfully, or 26-105 and 145-513, respectfully, of one of SEQ ID NOs: 185 (DS, subtype A), 371 (DS-Cav1, subtype A), 372 (DSCav1, subtype B), 373 (DSCav1, bovine), 374 (DS S190F, subtype A), 375 (DS, S190F, subtype B), or 376 (DS, S190F, bovine).

Clause 37. The immunogen of clause 18, wherein the recombinant RSV F protein is stabilized in the RSV F protein prefusion conformation by a repacking amino acid substitution, wherein the $F_1$ polypeptide comprises the amino acid substitutions set forth in one of: 64L, 79V, 86W, 193V, 195F, 198F, 199F, 203F, 207L, and 214L; 64L, 79L, 86W, 193V, 195F, 198F, 199F, 203F, and 214L; 64W, 79V, 86W, 193V, 195F, 198F, 199F, 203F, 207L, and 214L; 79V, 86F, 193V, 195F, 198F, 199F, 203F, 207L, and 214L; 64V, 79V, 86W, 193V, 195F, 198F, 199Y, 203F, 207L, and 214L; 64F, 79V, 86W, 193V, 195F, 198F, 199F, 203F, 207L, and 214L; 64L, 79V, 86W, 193V, 195F, 199F, 203F, 207L, and 214L; 56I, 58I, 64I, 171I, 179L, 181F, 187I, 291V, 296I, and 298I; 56I, 58I, 164I, 179L, 189F, 291V, 296I, and 298I; 56L, 58I, 158W, 164L, 167V, 171I, 179L, 181F, 187I, 291V, and 296L; 56L, 58I, 158Y, 164L, 167V, 187I, 189F, 291V, and 296L; 56I, 58W, 164I, 167F, 171I, 179L, 181V, 187I, 291V, and 296I; 56I, 58I, 64L, 79V, 86W, 164I, 179L, 189F, 193V, 195F, 198F, 199F, 203F, 207L, 214L, 291V, 296I, and 298I; 56I, 58I, 79V, 86F, 164I, 179L, 189F, 193V, 195F, 198F, 199F, 203F, 207L, 214L, 291V, 296I, and 298I; 56I, 58W, 64V, 79V, 86W, 164I, 167F, 171I, 179L, 181V, 187I, 193V, 195F, 198F, 199F, 203F, 207L, 214L, 291V, and 296I; 56I, 58W, 79V, 86F, 164I, 167F, 171I, 179L, 181V, 187I, 193V, 195F, 198F, 199F, 203F, 207L, 214L, 291V, and 296I; 486N, 487Q, 489N, and 491A; 486H, 487Q, and 489H; 400V, 486L, 487L, and 489L; 400V, 486I, 487L, and 489I; 400V, 485I, 486L, 487L, 489L, 494L, and 498L; 400V, 485I, 486I, 487L, 489I, 494L, and 498L; 399I, 400V, 485I, 486L, 487L, 489L, 494L, 497L, and 498L; 399I, 400V, 485I, 486I, 487L, 489I, 494L, 497L, and 498L; 375W, 391F, and 394M; 375W, 391F, and 394W; 375W, 391F, 394M, 486N, 487Q, 489N, and 491A; 375W, 391F, 394W, 486H, 487Q, 489H; 375W, 391F, 394W, 486N, 487Q, 489N, and 491A; 375W, 391F, 394W, 486H, 487Q, and 489H; 375W, 391F, 394M, 400V, 486L, 487L, 489L, 494L, and 498M; 375W, 391F, 394M, 400V, 486I, 487L, 489I, 494L, and 498M; 375W, 391F, 394W, 400V, 486L, 487L, 489L, 494L, and 498M; 375W, 391F, 394W, 400V, 486I, 487L, 489I, 494L, and 498M; 137W and 339M; 137W and 140W; 137W, 140W, and 488W; 486N, 487Q, 489N, 491A, and 488W; 486H, 487Q, 489H, and 488W; 400V, 486L, 487L, 489L, and 488W; 400V, 486I, 487L, 489I, and 488W; 486N, 487Q, 489N, 491A, 137W, and 140W; 486H, 487Q, 489H, 137W, and 140W; 400V, 486L, 487L, 489L, 137W, and 140W; 375W, 391F, 394M, 137W, and 140W; or 375W, 391F, 394M, 137W, 140W, and 339M substitutions; and wherein the amino acid positions correspond to the amino acid sequence of a reference $F_O$ polypeptide set forth as SEQ ID NO: 124.

Clause 38. The immunogen of clause 37, wherein the recombinant RSV F protein is stabilized in the RSV F protein prefusion conformation by the repacking amino acid substitution, wherein the $F_1$ polypeptide comprises the amino acid substitutions set forth in one of: I64L, I79V, Y86W, L193V, L195F, Y198F, I199F, L203F, V207L, and I214L; I64L, I79L, Y86W, L193V, L195F, Y198F, I199F, L203F, and I214L; I64W, I79V, Y86W, L193V, L195F, Y198F, I199F, L203F, V207L, and I214L; I79V, Y86F, L193V, L195F, Y198F, I199F, L203F, V207L, and I214L; I64V, I79V, Y86W, L193V, L195F, Y198F, I199Y, L203F, V207L, and I214L; I64F, I79V, Y86W, L193V, L195F, Y198F, I199F, L203F, V207L, and I214L; I64L, I79V, Y86W, L193V, L195F, I199F, L203F, V207L, and I214L; V56I, T58I, V164I, L171I, V179L, L181F, V187I, I291V, V296I, and A298I; V56I, T58I, V164I, V179L, T189F, I291V, V296I, and A298I; V56L, T58I, L158W, V164L, I167V, L171I, V179L, L181F, V187I, I291V, and V296L; V56L, T58I, L158Y, V164L, I167V, V187I, T189F, I291V, and V296L; V56I, T58W, V164I, I167F, L171I, V179L, L181V, V187I, I291V, and V296I; V56I, T58I, I64L, I79V, Y86W, V164I, V179L, T189F, L193V, L195F, Y198F, I199F, L203F, V207L, I214L, I291V, V296I, and A298I; V56I, T58I, I79V, Y86F, V164I, V179L, T189F, L193V, L195F, Y198F, I199F, L203F, V207L, I214L, I291V, V296I, and A298I; V56I, T58W, I64L, I79V, Y86W, V164I, I167F, L171I, V179L, L181V, V187I, L193V, L195F, Y198F, I199F, L203F, V207L, I214L, I291V, and V296I; V56I, T58W, I79V, Y86W, V164I, I167F, L171I, V179L, L181V, V187I, L193V, L195F, Y198F, I199F, L203F, V207L, I214L, I291V, and V296I; D486N, E487Q, D489N, and S491A; D486H, E487Q, and D489H; T400V, D486L, E487L, and D489L; T400V, D486I, E487L, and D489I; T400V, S485I, D486L, E487L, D489L, Q494L, and K498L; T400V, S485I, D486I, E487L, D489I, Q494L, and K498L; K399I, T400V, S485I, D486L, E487L, D489L, Q494L, E497L, and K498L; K399I, T400V, S485I, D486I, E487L, D489I, Q494L, E497L, and K498L; L375W, Y391F, and K394M; L375W, Y391F, and K394W; L375W, Y391F, K394M, D486N, E487Q, D489N, and S491A; L375W, Y391F, K394M, D486H, E487Q, and D489H; L375W, Y391F, K394W, D486N, E487Q, D489N, and S491A; L375W, Y391F, K394W, D486H, E487Q, and D489H; L375W, Y391F, K394M, T400V, D486L, E487L, D489L, Q494L, and K498M; L375W, Y391F, K394M, T400V, D486I, E487L, D489I, Q494L, and K498M; L375W, Y391F, K394W, T400V, D486L, E487L, D489L, Q494L, and K498M; L375W, Y391F, K394W, T400V, D486I, E487L, D489I, Q494L, and K498M; F137W and R339M; F137W and F140W; F137W, F140W, and F488W; D486N, E487Q, D489N, S491A, and F488W; D486H, E487Q, D489H, and F488W; T400V, D486L, E487L, D489L, and F488W; T400V, D486I, E487L, D489I, and F488W; D486N, E487Q, D489N, S491A, F137W, and F140W; D486H, E487Q, D489H, F137W, and F140W; T400V, D486L, E487L, D489L, F137W, and F140W; L375W, Y391F, K394M, F137W, and F140W; or L375W, Y391F, K394M, F137W, F140W, and R339M; and wherein the amino acid positions correspond to the amino acid sequence of a reference F₀ polypeptide set forth as SEQ ID NO: 124.

Clause 39. The immunogen of clause 38, wherein the recombinant RSV F protein is stabilized in the RSV F protein prefusion conformation by a repacking amino acid substitution, wherein the F₁ polypeptide comprises positions 137-513 of one of SEQ ID NO: 227-242, 249-256, 286-295, or 326-337.

Clause 40. The immunogen of any of clauses 18-39, wherein the recombinant RSV F protein is stabilized in the RSV F protein prefusion conformation by a N-linked glycosylation site, wherein the N-linked glycosylation site is at one of F₁ polypeptide positions 506, 175, 178, 276, 476, 185, 160, 503, 157, or a combination of two or more thereof, wherein the amino acid positions correspond to the amino acid sequence of a reference F₀ polypeptide set forth as SEQ ID NO: 124.

Clause 41. The immunogen of clause 40, wherein the recombinant RSV F protein comprises one of (a) I506N and K508T; (b) A177S; (c) V178N; (d) V278T; (e) Y478T; (f) V185N and V187T; (g) L160N and G162S; (h) L503N and F505S; (i) V157N; (j) or a combination of two or more of (a)-(j); and wherein the amino acid positions correspond to the amino acid sequence of a reference F₀ polypeptide set forth as SEQ ID NO: 124.

Clause 42. The immunogen of clause 41, wherein the recombinant RSV F protein is stabilized in the RSV F protein prefusion conformation by a N-linked glycosylation site, and wherein the F₁ polypeptide comprises positions 137-513 of one of SEQ ID NOs: 198-200, 203-204, 214-217.

Clause 43. The immunogen of any one of clauses 18, wherein the recombinant RSV F protein is stabilized in the RSV F protein prefusion conformation comprises the amino acid substitutions set forth as one of: S238C and E92C; L193C and I59C; I59C and L297C; L297C and I292C; K176C and S190C; T189C and A177C; T58C and K191C; A424C and V450C; L171C and K191C; K176C and S190C; K77C and I217C; K427C and D448C; G151C and N302C; G151C and V300C; T189C and V56C; L171C and K191C; L230F; L158F; L230F and L158F; L203F; V187F; Y198F; Y198W; L204F; Y53F and L188F; V187F and L203F; Y198F and L203F; L141W; L142F; L142W; V144F; V144W; V90F; L83F; V185F and T54A; I395F; V90F, V185F, and T54A; L83F and V90F; L83F, V185F, and T54A; L230F, V90F, and I395F; I395F, V185F, and T54A; L203F, V90F, L230F, L158F, S509F, I395F, V185F, and T54A; I221Y; F140W; F137W; S190L and V192L; V187F, S190L, and V192L; V187L, S190L, and V192L; V185F, V187L, S190L, and V192L; V154L, V157L, V185L, and V187L; V154L, V185L, and V187L; V187F; T58L A298L; T58L, V154L, V185L, V187L, and A298L; Y458W; L158F and I167A; L158W and I167A; L158F; L158W; V56L, I167L, and A298L; V56L, I167L, and A298M; V56L and A167L; I167F; I167M; V154F; V56L, I167L, A298L, and V154F; I199L, L203F; I199L, L203F, P205Q, and I206T; I199L, L203F, P205E, and I206K; I199L, L203F, and V207F; I199L, L203F, P205Q, I206T, and V207F; I199L, L203F, P205E, I206K, and V207F; I199L, L203F, and L83F; I199L, L203F, P205Q, I206T, and L83F; I199L, L203F, P205E, I206K, and L83F; I199L, L203F, S190L, and V192L; I199L, L203F, P205Q, I206T, V187F, and S190L, V192L; S155A, S190M, L203F, V207I, and V296I; Y53F, S155A, K176I, S190L, V207I, S259L, D263L, and V296I; L158F, V207M, and V296I; V56L, V207M, and V296I; V56L, V207I, and V296I; V56I, V207M, and V296I; V154L, V207M, and V296I; Y198F, V207I, T219W, and V296I; Y198F, V207I, T219I, and V296I; Y198F, V207M, T219W, and V296I; 198F, V207M, T219I, and V296I; Y198F, V207M, T219L, and V296I; S190Y; S190W; I206F, V207M, T219V, and V296I; Y198F, V207M, T219L, and K226M; Y198F, V207M, T219L, and K226W; Y198F, V207M, T219L, and K226L; L158F, L203F, V207I, and V296I; F488W; F488R; V207L; S190F; S190M; L503E, I506K, and S509F; L503E, I506K, S509F, and F505W; L503E, I506K, S509F, L230F, and L158F; Q279C and S238C; Q501F; E82V, V207M, N227L, and V296I; E82V, V207I, N227L, and V296I; L158F, Y198F, V207M, S215G, N216P, and T219L; L158F, Y198F, V207M, S213G, S215G, and T219L; V56L, E82V, L203F, V207M, N227L, L230F, and V296I; E82V, L158F, L203F, V207M, N227L, L230F, and V296I; E82V, L203F, V207M, K226M, N227L, L230F, and V296I; or L203F, V207I, S180C, S186C, and V296I; wherein the amino acid positions correspond to the amino acid sequence of a reference F₀ polypeptide set forth as SEQ ID NO: 124.

Clause 44. The immunogen of clause 18, wherein the recombinant RSV F protein comprises S155C and S290C substitutions, and further comprises one of the following sets of substitutions: L513C, 514E, and 515C; L513C, 514E, 515E, and 516C; L512C, 513E, and 514C; or L512C, 513E, 514E, and 515C;

S155C, S290C, and S190F substitutions, and further comprises one of the following sets of substitutions: F488W, L513C, A514E, and I515C; F488W, L513C, A514E, G515E, and 516C; F488W, L512C, L513E, and A514C; F488W, L512C, L513E, A514E, and G515C; A424C, V450C, L171C, K191C, F488W, L513C, A514E, and I515C; A424C, V450C, L171C, K191C, F488W, L513C, A514E, G515E, and 516C; A424C, V450C, L171C, K191C, F488W, L512C, L513E, and A514C; A424C, V450C, L171C, K191C, F488W, L512C, L513E, A514E, and G515C; K77C, I217C, A424C, V450C, L171C, K191C, F488W, L513C, L514E, and A515C; K77C, I217C, A424C, V450C, L171C, K191C, F488W, L513C, L514E, and A515E; K77C, I217C, A424C, V450C, L171C, K191C, F488W, L512C, L513E, and A514C; or K77C, I217C, A424C, V450C, L171C, K191C, F488W, L512C, L513E, A514E, and G515C;

S155C, S290, S190F, and V207L substitutions, and further comprises one of the following sets of substitutions: L503E, and I506K; L503E, I506K, and F505W; L503E, I506K, L230F, and L158F; L503E, I506K, S509F, F505W, L230F, and L158F; L160K, V178T, L258K, V384T, I431S, and L467Q; F477K, L481Q, V482K, L503Q, and I506K; L160K, V178T, L258K, V384T, I431S, L467Q, F477K, L481Q, V482K, L503Q, and I506K; L512C, and L513C; L512C, L513C, L160K, V178T, L258K, V384T, I431S, and L467Q; L512C, L513C, F477K, L481Q, V482K, L503Q, and I506K; L512C, L513C, L160K, V178T, L258K, V384T, I431S, L467Q, F477K, L481Q, V482K, L503Q, and I506K; F505W; F505W L160K, V178T, L258K, V384T, I431S, and L467Q; F505W F477K, L481Q, V482K, L503Q, and I506K; F505W L160K, V178T, L258K, V384T, I431S, L467Q, F477K, L481Q, V482K, L503Q, and I506K; L512C, L513C, and F505W; L512C, L513C F505W L160K, V178T, L258K, V384T, I431S, and L467Q; L512C, L513C F505W F477K, L481Q, V482K, L503Q, and I506K; L512C, L513C F505W L160K, V178T, L258K, V384T, I431S, L467Q, F477K, L481Q, V482K, L503Q, and I506K; I506K, S509F, L83F, and V90F; I506K, S509F, L83F, V90F, L230F, and L158F; I506K, S509F, F505W, L83F, V90F, L230F, V185F, and T54A; L83F, V90F, L230F, and I395F; I506K, S509F, F505W, L83F, V90F, L230F, L158F, I395F, V185F, and T54A; L512C, and L513C; or 486DEF to CPC, wherein the amino acid positions correspond to the amino acid sequence of a reference $F_0$ polypeptide set forth as SEQ ID NO: 124.

Clause 45. The immunogen of clause 18, wherein the recombinant RSV F protein is stabilized in the RSV F protein prefusion and comprises F2 and F1 polypeptides comprising the amino acid sequence set forth as positions 26-109 and 137-513, respectively, of one of SEQ ID NOs: 338-433, 434-544, 672-682.

Clause 46. The immunogen of any one of clauses 1-18, wherein the recombinant RSV F protein comprises the amino acid substitutions set forth in one of rows 1-16 of Table 5b (newer interchain disulfides);

rows 1-84 of Table 6b (newer cavity filling);
rows 1-54 of Table 8b (newer combinations with DSCav-1); or
rows 1-13 of Table 8c ((newer cavity filling+replacing exposed hydrophobic residues); and
wherein the amino acid positions correspond to the amino acid sequence of a reference $F_0$ polypeptide set forth as SEQ ID NO: 124.

Clause 47. The immunogen of any one of clauses 1-18, wherein the recombinant RSV F protein is a single chain protein and comprises an amino acid sequence at least 80% identical to any one of SEQ ID NOs: 698-828 or 1474-1478.

Clause 48. The immunogen of any one of clauses 1-18, wherein the recombinant RSV F protein is a single chain protein and comprises an amino acid sequence at least 80% identical to any one of SEQ ID NOs: 698-828 or 1474-1478, optionally without the protein tags or leader sequences listed in the corresponding SEQ ID NO.

Clause 49. The immunogen of any one of clauses 1-18, wherein the recombinant RSV F protein comprises a trimerization domain, further comprising a protease cleavage site between the Foldon domain and the recombinant RSV F protein.

Clause 50. The immunogen of any one of clauses 1-18, wherein recombinant RSV F protein comprises the amino acid substitutions listed in the row of Table 23 corresponding to one of SEQ ID NOs: 829-1025.

Clause 51. The immunogen of any one of clauses 1-18, wherein the recombinant RSV F protein comprises the amino acid substitutions listed in the row of Table 23 corresponding to one of SEQ ID NOs: 969-1025.

Clause 52. The immunogen of any one of clauses 1-18, wherein the immunogen comprises one or more of the following amino acid substitutions: DSCav1-F137C, and R339C; DSCav1-F137C and T337C; DSCav1-G139C and Q354C; F137C, R339C; F137C, T337C; G139C, Q354C; L260F; L260W; L260Y; L260R; L188F; L188W; L188Y; L188R; I57F; I57W; I57R; L252F; L252W; L252R; V192F; V192W; V192R; S150C and Y458C; A149C and N460C; S146C, and N460C; A149C and Y458C; V220F; V220W; V220M; T219F; T219M; T219W; T219R; I221F; I221Y; I221W; Q224D and, L78K; V278F Q279F N277D and, S99K; Q361F; V402F; T400F; T400W; H486F; H486W; I217F; I217Y; I217W; F190V; K226L; T58I, and A298M; F190V and K226L; F190V, and T58I, A298M; K226L, T58I, and A298M; T58I, A298M, F190V and K226L, and optionally further comprises S155C and S290C substitutions, or S155C, S290C, S190F and V207L substitution.

Clause 53. The immunogen of any one of clauses 1-18, wherein the immunogen comprises an amino acid sequence at least 80% identical to the amino acid sequence of one of SEQ ID NOs: 829-1025, optionally without the protein tags or leader sequences listed in the corresponding SEQ ID NO.

Clause 54. The immunogen of any one of clauses 53, wherein the recombinant RSV F protein comprises a trimerization domain, further comprising a protease cleavage site between the Foldon domain and the recombinant RSV F protein.

Clause 55. The immunogen of any one of clauses 1-18, wherein recombinant RSV F protein comprises the amino acid substitutions listed in the row of Table 24 corresponding to one of SEQ ID NOs: 901-968.

Clause 56 The immunogen of any one of clauses 1-18, wherein the immunogen comprises an amino acid sequence at least 80% identical to the amino acid sequence of one of SEQ ID NOs: 901-968, optionally without the protein tags or leader sequences listed in the corresponding SEQ ID NO.

Clause 57. The immunogen of clause 7, wherein the recombinant RSV F protein or fragment thereof comprises or consists of an amino acid sequence at least 80% identical to the following RSV $F_2$ and $F_1$ positions as set forth in any one of SEQ ID NOs: 1-184:

(a) 56-97 and 189-211, respectively; (b) 58-97 and 192-242, respectively; (c) 59-97 and 194-240, respectively; (d) 60-75 and 193-218, respectively; (e) 60-94 and 192-229, respectively; (f) 60-94 and 192-232, respectively; (g) 60-94 and 193-237, respectively; (h) 60-95 and 192-240, respectively; (i) 60-96 and 192-239, respectively; (j) 60-97 and 192-242, respectively; (k) 60-97 and 194-239, respectively; (l) 61-96 and 192-235, respectively; (m) 61-96 and 192-240, respectively (n) 62-69 and 196-209, respectively; or (o) a circular permutation of the $F_2$ and $F_1$ positions listed in any one of (a)-(m), wherein the RSV $F_2$ and $F_1$ positions are joined by a heterologous linker.

Clause 58. The immunogen of clause 7, wherein the recombinant RSV F protein or fragment thereof comprises or consists of an amino acid sequence at least 80% identical to the following RSV $F_2$ and $F_1$ positions as set forth in any one of SEQ ID NOs: 1-184:

(a) 46-103 and 147-310, respectively; (b) 46-104 and 146-310, respectively; (c) 50-96 and 149-306, respectively; (d) 51-103 and 146-307, respectively; (e) 51-103 and 139-307, respectively; (f) 50-105 and 146-306, respectively; (g) 53-97 and 148 to one of 305-320; (h) a circular permutation of the $F_2$ and $F_1$ positions listed in any one of (a)-(g), wherein the RSV $F_2$ and $F_1$ positions are joined by a heterologous linker or are directly linked.

Clause 59. The immunogen of clause 57 or 58, wherein the recombinant RSV F protein or fragment thereof comprises the amino acid sequence of any one of the minimal site Ø immunogens listed in Table 20.

Clause 60. The immunogen of clause 57 or 58, wherein the recombinant RSV F protein or fragment thereof comprises an amino acid sequence at least 80% identical to the amino acid sequence of one of SEQ ID NOs: 1027-1218.

Clause 61. The immunogen of clause 57 or 58, wherein the recombinant RSV F protein or fragment thereof comprises an amino acid sequence at least 80% identical to the amino acid sequence of one of SEQ ID NOs: 1027-1218, optionally without the protein tags or leader sequences listed in the corresponding SEQ ID NO.

Clause 62. The immunogen any of clauses 58-61, wherein the recombinant RSV F protein comprises
cysteine substitutions at position 155 and 290, and a F, L, W, Y, H, or M substitution at position 190, position 207, or positions 190 and 207.

Clause 63. The immunogen any of clauses 58-61, wherein the recombinant RSV F protein comprises S155C and S290C substitutions; S155C, S290C, and S190F substitutions, or S155C, S290C, S190F, and V207L substitutions.

Clause 64. The immunogen of any of clauses 58-61, wherein the recombinant RSV F protein or fragment thereof comprises or consists of the $F_1$-linker-F2 sequence or F2-linker-$F_1$ sequence of any one of SEQ ID NOs: 1027-1218.

Clause 65. The immunogen of any of clauses 57-64, wherein the heterologous linker comprises or consists of the amino acid sequence set forth as any one of SEQ ID NOs: 1443-1455, or a G, S, GG, GS, SG, GGG, or GSG linker.

Clause 66. The immunogen of any of the previous clauses, comprising a multimer of the recombinant RSV F protein or fragment thereof.

Clause 67. The immunogen of any of the previous clauses, wherein the recombinant RSV F protein is linked to a scaffold protein.

Clause 68. The immunogen of any of clauses 1-56, wherein the F1 polypeptide comprises an RSV α10 helix comprising from RSV position 492 to one of positions 510-529, and wherein the F1 polypeptide comprises at least two cysteine substitutions that form a non-natural interprotomer disulfide bond.

Clause 69. The immunogen of 68, wherein positions 512-524 of the F1 polypeptide comprise the amino acid sequence set forth as CCHNVNAGKSTTN (residues 512-524 of SEQ ID NO: 844) or CCHNVNACCSTTN (residues X-Y of SEQ ID NO: 849); or wherein positions 512-529 of the F1 polypeptide comprise the amino acid sequence set forth as CCHNVNACCSTTNICCTT (residues 512-529 of SEQ ID NO: 853).

Clause 70. The isolated immunogen of any one of the previous clauses, wherein the recombinant RSV F protein further comprises an additional disulfide bond comprising a pair of crosslinked cysteines at $F_1$ positions:

(a) 486 and 487;
(b) 512 and 513;
(c) 519 and 520;
(d) 526 and 527;
(e) 486 and 487, wherein the $F_1$ polypeptide further comprises a P inserted between positions 486 and 487;
(f) 330 and 493; wherein the $F_1$ polypeptide further comprises a C inserted between positions C insertion between positions 329 and 330; or
(g) 330 and 493; wherein the $F_1$ polypeptide further comprises a C inserted between positions 329 and 330, and a G insertion between positions 492 and 493;
wherein the amino acid positions correspond to the amino acid sequence of a reference $F_0$ polypeptide set forth as SEQ ID NO: 124.

Clause 71. The immunogen of any of the previous clauses, wherein the recombinant RSV F protein or fragment thereof or epitope scaffold protein is linked to a trimerization domain.

Clause 72. The immunogen of clause 71, wherein the C-terminus of the $F_1$ polypeptide of the recombinant RSV F protein is linked to the trimerization domain.

Clause 73. The immunogen of clause 71 or clause 72, wherein the trimerization domain is a Foldon domain.

Clause 74. The immunogen any of clauses 71-73, further comprising a protease cleave site between the $F_1$ polypeptide and the trimerization domain.

Clause 75. The immunogen of clause 74, further comprising a transmembrane domain between the protease cleave site and the trimerization domain.

Clause 76. The isolated immunogen of clause 75, wherein the RSV F protein is stabilized in the F protein prefusion conformation by (a) the disulfide bond, wherein the $F_2$ polypeptide and the $F_1$ polypeptide linked to the Foldon domain comprise the amino acid sequence set forth as positions 26-109 and 137-544, respectively, of any one of SEQ ID NOs: 185, 189, 190, 201, 202, 205, 207, 209, 211, 212, 213, 244, 245, 247, 257, 258, 259, 260, 261, 262, 263, 264, 265, 266, 267, 268, 269, 270, 271, 272, 273, 274, 275, 277, 278, 279, 280, 281, 282, 284, 302, 303, 243, 246, 276, 283, 285, 296, 297, 298, or 299;

(b) the cavity-filling amino acid substitution, wherein the $F_2$ polypeptide and the $F_1$ polypeptide linked to the Foldon domain comprise the amino acid sequence set forth as positions 26-109 and 137-544, respectively, of any one of SEQ ID NOs: 191, 193, 196, 197, 248, 192, 195, or 194;

(c) the repacking amino acid substitution, wherein the $F_2$ polypeptide and the $F_1$ polypeptide linked to the Foldon domain comprise the amino acid sequence set forth as positions 26-109 and 137-544, respectively, of any one of SEQ ID NOs: 249, 250, 251, 252, 253, 254, 255, 256, 288, 289, 290, 291, 292, 293, 294, 295, 296, 297, 326, 327, 328, 329, 330, 331, 332, 333, 334, 335, 336, or 337; or (d) the N-linked glycosylation site, wherein the $F_2$ polypeptide and the $F_1$ polypeptide linked to the Foldon domain comprise the amino acid sequence set forth as positions 26-109 and 137-544, respectively, of any one of SEQ ID NOs selected from the group consisting of SEQ ID NOs: 198, 199, 200, 203, 204, 214, 215, 216, or 217;

(e) the disulfide bond and the cavity filling substitution, wherein the $F_2$ polypeptide and the $F_1$ polypeptide linked to the Foldon domain comprise the amino acid sequence set forth as positions 26-109 and 137-544, respectively, of any one of SEQ ID NOs selected from the group consisting of SEQ ID NOs: 371, 372, 373, 374, 375, 376; and wherein the amino acid positions correspond to the amino acid sequence of a reference $F_0$ polypeptide set forth as SEQ ID NO: 124.

Clause 77. The isolated immunogen of clause 75, wherein the $F_2$ polypeptide and the $F_1$ polypeptide linked to the Foldon domain comprise the amino acid sequence set forth as positions 26-109 and 137-548, respectively, of any one of SEQ ID NO: 552; 553; 554; 555; 556; 557; 558; 559; 560; 561; 562; 563; 564; 565; 566; 567; 568; 569; 570; 571; 572; 573; 574; 575; 576; 577; 578; 579; 580; 581; 582; 583; 584; 585; 586; 587; 588; 589; 590; 591; 592; 593; and 601; 683; 684; 685; 686; 687; 688; 689; 690; 691; 692; or 693.

wherein the amino acid positions correspond to the amino acid sequence of a reference $F_0$ polypeptide set forth as SEQ ID NO: 124.

Clause 78. The immunogen of any one of the previous clauses, wherein the recombinant RSV F protein or fragment thereof or epitope scaffold protein is linked to a protein nanoparticle subunit.

Clause 79. The immunogen of clause 78, wherein the C-terminus of the recombinant RSV F protein or fragment thereof or epitope scaffold protein is linked to the protein nanoparticle subunit.

Clause 80. The immunogen of clause 78 or clause 79, wherein the protein nanoparticle subunit is a ferritin, encapsulin, Sulfur Oxygenase Reductase (SOR), lumazine synthase, or pyruvate dehydrogenase nanoparticle subunit.

Clause 81. The immunogen of clause 78, wherein:
the ferritin nanoparticle subunit comprises an amino acid sequence having at least 80% sequence identity to residues 517-679 of SEQ ID NO: 350, and optionally includes a C31S, C31A or C31V substitution in the ferritin polypeptide;
the SOR subunit comprises an amino acid sequence having at least 80% sequence identity to residues 516-825 of SEQ ID NO: 344 or SEQ ID NO: 345;
the lumazine synthase subunit comprises an amino acid sequence having at least 80% sequence identity to residues 517-670 of SEQ ID NO: 346 or SEQ ID NO: 348, or residues 517-669 of SEQ ID NO: 347; or the pyruvate dehydrogenase synthase subunit an amino acid sequence having at least 80% sequence identity to residues 516-757 of SEQ ID NO: 349.

Clause 82. The immunogen of clause 78, comprising a single chain RSV F protein linked to a ferritin subunit comprising an amino acid sequence at least 80% identical one of SEQ ID NOs: 827-828 or 1429-1442

Clause 83. The immunogen of clause 78, wherein the recombinant RSV F protein or fragment thereof is linked to a nanoparticle subunit, and comprises the amino acid sequence of any one of the Minimal site Ø immunogens linked to a protein nanoparticle as listed in Table 21.

Clause 84. The immunogen of clause 78, wherein the recombinant RSV F protein or fragment thereof is linked to a nanoparticle subunit, comprises an amino acid sequence at least 80% identical to the amino acid sequence of one of SEQ ID NOs: 1219-1428.

Clause 85. The immunogen of clause 78, wherein the recombinant RSV F protein, or fragment thereof is linked to a nanoparticle subunit and comprises an amino acid sequence at least 80% identical to the amino acid sequence of one of SEQ ID NOs: 1219-1428, optionally without the protein tags or leader sequences listed in the corresponding SEQ ID NO.

Clause 86. The immunogen of any of the previous clauses, wherein the recombinant RSV F protein forms a trimer in phosphate buffered saline at physiological pH at room temperature.

Clause 87. The immunogen any of the previous clauses, wherein the immunogen forms a homogeneous population of immunogens when incubated in aqueous solution, wherein at least 70%, at least 80%, at least 90%, and/or at least 95% of the immunogens incubated in the solution specifically bind to the prefusion-specific antibody after:
(a) incubation for one hour in 350 mM NaCl pH 7.0, at 50° C.;
(b) incubation for one hour in 350 mM NaCl pH 3.5, at 25° C.;
(c) incubation for one hour in 350 mM NaCl pH 10, at 25° C.;
(d) incubation for one hour in 10 mM osmolarity, pH 7.0, at 25° C.;
(e) incubation for one hour in 3000 mM osmolarity, pH 7.0, at 25° C.; or
(f) ten freeze-thaw cycles in 350 mM NaCl pH 7.0; or
(g) a combination of two or more of (a)-(f); wherein the immunogen is incubated in the solution in the absence of the prefusion-specific antibody.

Clause 88. The immunogen any of the previous clauses, wherein:
(a) the recombinant RSV F protein or fragment thereof does not include a disulfide bond between RSV F positions 481 and 489, or between RSV F positions 509 and 510;
(b) the recombinant RSV F protein or fragment thereof does not include a cysteine residue at RSV F positions 481, 489, 509, 510 or a combination thereof;
(c) a combination of (a) and (b).

Clause 89. The isolated immunogen of any one of clauses 1-70, wherein the C-terminus of the $F_1$ polypeptide, is linked to a transmembrane domain.

Clause 90. The isolated immunogen of clause 89, wherein transmembrane domain is a RSV F transmembrane domain.

Clause 91. The isolated immunogen of clause 89 or 90, wherein the C-terminus of the transmembrane domain is linked to a RSV F cytosolic domain.

Clause 92. The isolated immunogen of any one of the previous clauses, wherein the immunogen is not stabilized in the prefusion conformation by non-specific crosslinking.

Clause 93. A virus-like particle comprising the immunogen of any one of clauses 1-70.

Clause 94. A protein nanoparticle comprising the immunogen of any one of clauses 1-85.

Clause 95. The protein nanoparticle of clause 94, wherein the protein nanoparticle is a ferritin nanoparticle, an encapsulin nanoparticle, a Sulfur Oxygenase Reductase (SOR) nanoparticle, a lumazine synthase nanoparticle or a pyruvate dehydrogenase nanoparticle.

Clause 96. The immunogen, of any one of clauses 1-92, wherein a Fab of monoclonal antibody D25 or AM22 specifically binds to the immunogen, the virus-like particle, or the protein nanoparticle with a $K_d$ of 1 µM or less.

Clause 97. The isolated immunogen of any one of clauses 1-85, wherein the immunogen comprises a D25 epitope comprising a three-dimensional structure that in the absence of monoclonal antibody D25 can be structurally superimposed onto the three-dimensional structure of a D25 epitope comprising residues 62-69 and 196-209 of SEQ ID NO: 370 in complex with monoclonal antibody D25 as defined by the atomic coordinates set forth in Table 1 with a root mean square deviation (RMSD) of their coordinates of less than 2.0 Å/residue, wherein the RMSD is measured over the polypeptide backbone atoms N, Cα, C, O, for at least three consecutive amino acids.

Clause 98. A nucleic acid molecule encoding the isolated immunogen of any one of clauses 1-92.

Clause 99. The nucleic acid molecule of clause 98, wherein the nucleic acid molecule encodes a precursor protein of the immunogen.

Clause 100. The nucleic acid molecule of clause 99, wherein the precursor protein comprises, from N- to C-terminus, a signal peptide, the $F_2$ polypeptide, a Pep27 polypeptide, and the $F_1$ polypeptide.

Clause 101. The nucleic acid molecule of clause 100, wherein the Pep27 polypeptide comprises the amino acid sequence set forth as positions 110-136 of any one SEQ ID NOs: 1-184 or 370, wherein the amino acid positions correspond to the amino acid sequence of a reference $F_0$ polypeptide set forth as SEQ ID NO: 124.

Clause 102. The nucleic acid molecule of clause 101, wherein the signal peptide comprises the amino acid sequence set forth as positions 1-25 of any one SEQ ID NOs: 1-184 or 370, wherein the amino acid positions correspond to the amino acid sequence of a reference $F_0$ polypeptide set forth as SEQ ID NO: 124.

Clause 103. The nucleic acid molecule of any one of clauses 99-102, codon optimized for expression in a human or a bovine cell.

Clause 104. The nucleic acid molecule of any one of clauses 99-103, operably linked to a promoter.

Clause 105. A vector comprising the nucleic acid molecule of clause 104.

Clause 106. The vector of clause 105, wherein the vector is a viral vector.

Clause 107. The viral vector of clause 106, wherein the viral vector is a bovine parainfluenza virus vector, a human parainfluenza virus vector, a Newcastle disease virus vector, a Sendai virus vector, a measles virus vector, an attenuated RSV vector, a paramyxovirus vector, an adenovirus vector, an alphavirus vector, a Venezuelan equine encephalitis vector, a Semliki Forest virus vector, a Sindbis virus vector, an adeno-associated virus vector, a poxvirus vector, a rhabdovirus vector, a vesicular stomatitis virus vector, a picornovirus vector, or a herpesvirus vector.

Clause 108. The vector of clause 106, wherein the vector is a bacterial vector.

Clause 109. The bacterial vector of clause 108, wherein the bacterial vector is a mycobacterial vector, a *salmonella* vector, a *shigella* vector, a *Listeria monocytogenes* vector, or a *lactobacillus* vector.

Clause 110. The nucleic acid molecule or vector of any one of clauses 98-109, comprising the nucleotide sequence set forth as SEQ ID NO: 383, SEQ ID NO: 384, SEQ ID NO: 385, or SEQ ID NO: 386.

Clause 111. An isolated host cell comprising the vector of any one of clauses 105-110.

Clause 112. An immunogenic composition comprising an effective amount of the immunogen, virus-like particle, protein nanoparticle, nucleic acid molecule, or vector of any one of clauses 1-110; and a pharmaceutically acceptable carrier.

Clause 113. The immunogenic composition of clause 112, further comprising an adjuvant.

Clause 114. The immunogenic composition of clause 113, wherein the adjuvant is alum, an oil-in water composition, MF59, AS01, AS03, AS04, MPL, QS21, a CpG oligonucleotide, a TLR7 agonist, a TLR4 agonist, or a combination of two or more thereof.

Clause 115. The immunogenic composition of clause 113, wherein the adjuvant promotes a Th1 immune response.

Clause 116. The immunogenic composition of any of clauses 112, further comprising a RSV F prefusion specific antibody that specifically binds the immunogen.

Clause 117. The immunogenic composition of any one of clauses 112, comprising a mixture of recombinant RSV F proteins or fragments thereof based on RSV F protein subtype A and B.

Clause 118. The immunogenic composition of clause 117, wherein the human subtype A RSV F protein comprises S155C, S290C, and S190F substitutions, and the human subtype B RSV F protein comprises S155C, S290C, and S190F substitutions; or the human subtype A RSV F protein comprises S155C, S290C, S190F, and V207L substitutions, and the human subtype B RSV F protein comprises S155C, S290C, S190F, and V207L substitutions.

Clause 119. A method for generating an immune response to RSV F in a subject, comprising administering to the subject an effective amount of the immunogenic composition of any one of clauses 112-118 to generate the immune response.

Clause 120. The method of clause 119, wherein the immune response comprises a Th1 immune response.

Clause 121. A method for treating or preventing a RSV infection in a subject, comprising administering to the subject a therapeutically effective amount of the immunogenic composition of any one of clauses 112-120, thereby treating or preventing RSV infection in the subject.

Clause 122. The method of any one of clauses 119-121, comprising a prime-boost administration of the immunogenic composition.

Clause 123. The method of clause 122, wherein the prime and boost comprise administration of a mixture of recombinant RSV F proteins or fragments thereof or nucleic acid molecules or protein nanoparticles based on RSV F protein subtype A and B.

Clause 124. A method for detecting or isolating an RSV F binding antibody in a subject, comprising:

providing an effective amount of the immunogen, virus-like particle, protein nanoparticle, nucleic acid molecule, or vector of any one of clauses 1-110;

contacting a biological sample from the subject with the recombinant RSV F protein or the protein nanoparticle under conditions sufficient to form an immune complex between the recombinant RSV F protein or the protein nanoparticle and the RSV F binding antibody; and detecting the immune complex, thereby detecting or isolating the RSV F binding antibody in the subject.

Clause 125. The method of any one of clauses 119-124, wherein the subject is at risk of or has an RSV infection.

Clause 126. The method of clause 125, wherein the RSV infection is a human RSV subtype A, human RSV subtype B, or bovine RSV infection.

Clause 127. The method of any one of clauses 119-126, wherein the subject is a human or a veterinary subject.

Clause 129. A kit comprising the immunogen, virus-like particle, protein nanoparticle, nucleic acid molecule, or vector of any one of clauses 1-110; and instructions for using the kit.

As used herein, reference to:

"any one of SEQ ID NOs: 1-184" refers to "SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO:

19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, or SEQ ID NO: 184"

"SEQ ID NOs: 698-828" refers to "any one of" SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, SEQ ID NO: 776, SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, SEQ ID NO: 788, SEQ ID NO: 789, SEQ ID NO: 790, SEQ ID NO: 791, SEQ ID NO: 792, SEQ ID NO: 793, SEQ ID NO: 794, SEQ ID NO: 795, SEQ ID NO: 796, SEQ ID NO: 797, SEQ ID NO: 798, SEQ ID NO: 799, SEQ ID NO: 800, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815, SEQ ID NO: 816, SEQ ID NO: 817, SEQ ID NO: 818, SEQ ID NO: 819, SEQ ID NO: 820, SEQ ID NO: 821, SEQ ID NO: 822, SEQ ID NO: 823, SEQ ID NO: 824, SEQ ID NO: 825, SEQ ID NO: 826, SEQ ID NO: 827, or SEQ ID NO: 828."

"SEQ ID NOs: 1474-1478" refers to "any one of SEQ ID NO: 1474, SEQ ID NO: 1475, SEQ ID NO: 1476, SEQ ID NO: 1477, or SEQ ID NO: 1478."

"SEQ ID NOs: 829-1025" refers to "any one of SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 864, SEQ ID NO: 865, SEQ ID NO: 866, SEQ ID NO: 867, SEQ ID NO: 868, SEQ ID NO: 869, SEQ ID NO: 870, SEQ ID NO: 871, SEQ ID NO: 872, SEQ ID NO: 873, SEQ ID NO: 874, SEQ ID NO: 875, SEQ ID NO: 876, SEQ ID NO: 877, SEQ ID NO: 878, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 915, SEQ ID NO: 916, SEQ ID NO: 917, SEQ ID NO: 918, SEQ ID NO: 919, SEQ ID NO: 920, SEQ ID NO: 921, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931, SEQ ID NO: 932, SEQ ID NO: 933, SEQ ID NO: 934, SEQ ID NO: 935, SEQ ID NO: 936, SEQ ID NO: 937, SEQ ID NO: 938, SEQ ID NO: 939, SEQ ID NO: 940, SEQ ID NO: 941, SEQ ID NO: 942, SEQ ID NO: 943, SEQ ID NO: 944, SEQ ID NO: 945, SEQ ID NO: 946, SEQ ID NO: 947, SEQ ID NO: 948, SEQ ID NO: 949, SEQ ID NO: 950, SEQ ID NO: 951, SEQ ID NO: 952, SEQ ID NO: 953, SEQ ID NO: 954, SEQ ID NO: 955, SEQ ID NO: 956, SEQ ID NO: 957, SEQ ID NO: 958, SEQ ID NO: 959, SEQ ID NO: 960, SEQ ID NO: 961, SEQ ID NO: 962, SEQ ID NO: 963, SEQ ID NO: 964, SEQ ID NO: 965, SEQ ID NO: 966, SEQ ID NO: 967, SEQ ID NO: 968, SEQ ID NO: 969, SEQ ID NO: 970, SEQ ID NO: 971, SEQ ID NO: 972, SEQ ID NO: 973, SEQ ID NO: 974, SEQ ID NO: 975, SEQ ID NO: 976, SEQ ID NO: 977, SEQ ID NO: 978, SEQ ID NO: 979, SEQ ID NO: 980, SEQ ID NO: 981, SEQ ID NO: 982, SEQ ID NO: 983, SEQ ID NO: 984, SEQ ID NO: 985, SEQ ID NO: 986, SEQ ID NO: 987, SEQ ID NO: 988, SEQ ID NO: 989, SEQ ID NO: 990, SEQ ID NO: 991, SEQ ID NO: 992, SEQ ID NO: 993, SEQ ID NO: 994, SEQ ID NO: 995, SEQ ID NO: 996, SEQ ID NO: 997, SEQ ID NO: 998, SEQ ID NO: 999, SEQ ID NO: 1000, SEQ ID NO: 1001, SEQ ID NO: 1002, SEQ ID NO: 1003, SEQ ID NO: 1004, SEQ ID NO: 1005, SEQ ID NO: 1006, SEQ ID NO: 1007, SEQ ID NO: 1008, SEQ ID NO: 1009, SEQ ID NO: 1010, SEQ ID NO: 1011, SEQ ID NO: 1012, SEQ ID NO: 1013, SEQ ID NO: 1014, SEQ ID NO: 1015, SEQ ID NO: 1016, SEQ ID NO: 1017, SEQ ID NO: 1018, SEQ ID NO: 1019, SEQ ID NO: 1020, SEQ ID NO: 1021, SEQ ID NO: 1022, SEQ ID NO: 1023, SEQ ID NO: 1024, or SEQ ID NO: 1025."

"SEQ ID NOs: 969-1025" refers to "any one of SEQ ID NO: 969, SEQ ID NO: 970, SEQ ID NO: 971, SEQ ID NO: 972, SEQ ID NO: 973, SEQ ID NO: 974, SEQ ID NO: 975, SEQ ID NO: 976, SEQ ID NO: 977, SEQ ID NO: 978, SEQ ID NO: 979, SEQ ID NO: 980, SEQ ID NO: 981, SEQ ID NO: 982, SEQ ID NO: 983, SEQ ID NO: 984, SEQ ID NO: 985, SEQ ID NO: 986, SEQ ID NO: 987, SEQ ID NO: 988, SEQ ID NO: 989, SEQ ID NO: 990, SEQ ID NO: 991, SEQ ID NO: 992, SEQ ID NO: 993, SEQ ID NO: 994, SEQ ID NO: 995, SEQ ID NO: 996, SEQ ID NO: 997, SEQ ID NO: 998, SEQ ID NO: 999, SEQ ID NO: 1000, SEQ ID NO: 1001, SEQ ID NO: 1002, SEQ ID NO: 1003, SEQ ID NO: 1004, SEQ ID NO: 1005, SEQ ID NO: 1006, SEQ ID NO: 1007, SEQ ID NO: 1008, SEQ ID NO: 1009, SEQ ID NO: 1010, SEQ ID NO: 1011, SEQ ID NO: 1012, SEQ ID NO: 1013, SEQ ID NO: 1014, SEQ ID NO: 1015, SEQ ID NO: 1016, SEQ ID NO: 1017, SEQ ID NO: 1018, SEQ ID NO: 1019, SEQ ID NO: 1020, SEQ ID NO: 1021, SEQ ID NO: 1022, SEQ ID NO: 1023, SEQ ID NO: 1024, or SEQ ID NO: 1025."

"SEQ ID NOs: 901-968" refers to "any one of SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 915, SEQ ID NO: 916, SEQ ID NO: 917, SEQ ID NO: 918, SEQ ID NO: 919, SEQ ID NO: 920, SEQ ID NO: 921, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931, SEQ ID NO: 932, SEQ ID NO: 933, SEQ ID NO: 934, SEQ ID NO: 935, SEQ ID NO: 936, SEQ ID NO: 937, SEQ ID NO: 938, SEQ ID NO: 939, SEQ ID NO: 940, SEQ ID NO: 941, SEQ ID NO: 942, SEQ ID NO: 943, SEQ ID NO: 944, SEQ ID NO: 945, SEQ ID NO: 946, SEQ ID NO: 947, SEQ ID NO: 948, SEQ ID NO: 949, SEQ ID NO: 950, SEQ ID NO: 951, SEQ ID NO: 952, SEQ ID NO: 953, SEQ ID NO: 954, SEQ ID NO: 955, SEQ ID NO: 956, SEQ ID NO: 957, SEQ ID NO: 958, SEQ ID NO: 959, SEQ ID NO: 960, SEQ ID NO: 961, SEQ ID NO: 962, SEQ ID NO: 963, SEQ ID NO: 964, SEQ ID NO: 965, SEQ ID NO: 966, SEQ ID NO: 967, or SEQ ID NO: 968."

"SEQ ID NOs: 1027-1218" refers to "any one of SEQ ID NO: 1027, SEQ ID NO: 1028, SEQ ID NO: 1029, SEQ ID NO: 1030, SEQ ID NO: 1031, SEQ ID NO: 1032, SEQ ID NO: 1033, SEQ ID NO: 1034, SEQ ID NO: 1035, SEQ ID NO: 1036, SEQ ID NO: 1037, SEQ ID NO: 1038, SEQ ID NO: 1039, SEQ ID NO: 1040, SEQ ID NO: 1041, SEQ ID NO: 1042, SEQ ID NO: 1043, SEQ ID NO: 1044, SEQ ID NO: 1045, SEQ ID NO: 1046, SEQ ID NO: 1047, SEQ ID NO: 1048, SEQ ID NO: 1049, SEQ ID NO: 1050, SEQ ID NO: 1051, SEQ ID NO: 1052, SEQ ID NO: 1053, SEQ ID NO: 1054, SEQ ID NO: 1055, SEQ ID NO: 1056, SEQ ID NO: 1057, SEQ ID NO: 1058, SEQ ID NO: 1059, SEQ ID NO: 1060, SEQ ID NO: 1061, SEQ ID NO: 1062, SEQ ID NO: 1063, SEQ ID NO: 1064, SEQ ID NO: 1065, SEQ ID NO: 1066, SEQ ID NO: 1067, SEQ ID NO: 1068, SEQ ID NO: 1069, SEQ ID NO: 1070, SEQ ID NO: 1071, SEQ ID NO: 1072, SEQ ID NO: 1073, SEQ ID NO: 1074, SEQ ID NO: 1075, SEQ ID NO: 1076, SEQ ID NO: 1077, SEQ ID NO: 1078, SEQ ID NO: 1079, SEQ ID NO: 1080, SEQ ID NO: 1081, SEQ ID NO: 1082, SEQ ID NO: 1083, SEQ ID NO: 1084, SEQ ID NO: 1085, SEQ ID NO: 1086, SEQ ID NO: 1087, SEQ ID NO: 1088, SEQ ID NO: 1099, SEQ ID NO: 1100, SEQ ID NO: 1101, SEQ ID NO: 1102, SEQ ID NO: 1103, SEQ ID NO: 1104, SEQ ID NO: 1105, SEQ ID NO: 1106, SEQ ID NO: 1107, SEQ ID NO: 1108, SEQ ID NO: 1109, SEQ ID NO: 1110, SEQ ID NO: 1111, SEQ ID NO: 1112, SEQ ID NO: 1113, SEQ ID NO: 1114, SEQ ID NO: 1115, SEQ ID NO: 1116, SEQ ID NO: 1117, SEQ ID NO: 1118, SEQ ID NO: 1119, SEQ ID NO: 1120, SEQ ID NO: 1121, SEQ ID NO: 1122, SEQ ID NO: 1123, SEQ ID NO: 1124, SEQ ID NO: 1125, SEQ ID NO: 1126, SEQ ID NO: 1127, SEQ ID NO: 1128, SEQ ID NO: 1129, SEQ ID NO: 1130, SEQ ID NO: 1131, SEQ ID NO: 1132, SEQ ID NO: 1133, SEQ ID NO: 1134, SEQ ID NO: 1135, SEQ ID NO: 1136, SEQ ID NO: 1137, SEQ ID NO: 1138, SEQ ID NO: 1139, SEQ ID NO: 1140, SEQ ID NO: 1141, SEQ ID NO: 1142, SEQ ID NO: 1143, SEQ ID NO: 1144, SEQ ID NO: 1145, SEQ ID NO: 1146, SEQ ID NO: 1147, SEQ ID NO: 1148, SEQ ID NO: 1149, SEQ ID NO: 1150, SEQ ID NO: 1151, SEQ ID NO: 1152, SEQ ID NO: 1153, SEQ ID NO: 1154, SEQ ID NO: 1155, SEQ ID NO: 1156, SEQ ID NO: 1157, SEQ ID NO: 1158, SEQ ID NO: 1159, SEQ ID NO: 1160, SEQ ID NO: 1161, SEQ ID NO: 1162, SEQ ID NO: 1163, SEQ ID NO: 1164, SEQ ID NO: 1165, SEQ ID NO: 1166, SEQ ID NO: 1167, SEQ ID NO: 1168, SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1180, SEQ ID NO: 1181, SEQ ID NO: 1182, SEQ ID NO: 1183, SEQ ID NO: 1184, SEQ ID NO: 1185, SEQ ID NO: 1186, SEQ ID NO: 1187, SEQ ID NO: 1188, SEQ ID NO: 1189, SEQ ID NO: 1190, SEQ ID NO: 1191, SEQ ID NO: 1192, SEQ ID NO: 1193, SEQ ID NO: 1194, SEQ ID NO: 1195, SEQ ID NO: 1196, SEQ ID NO: 1197, SEQ ID NO: 1198, SEQ ID NO: 1199, SEQ ID NO: 1200, SEQ ID NO: 1201, SEQ ID NO: 1202, SEQ ID NO: 1203, SEQ ID NO: 1204, SEQ ID NO: 1205, SEQ ID NO: 1206, SEQ ID NO: 1207, SEQ ID NO: 1208, SEQ ID NO: 1209, SEQ ID NO: 1210, SEQ ID NO: 1211, SEQ ID NO: 1212, SEQ ID NO: 1213, SEQ ID NO: 1214, SEQ ID NO: 1215, SEQ ID NO: 1216, SEQ ID NO: 1217, or SEQ ID NO: 1218."

"SEQ ID NOs: 1429-1442" refers to "any one of SEQ ID NO: 1429, SEQ ID NO: 1430, SEQ ID NO: 1431, SEQ ID NO: 1432, SEQ ID NO: 1433, SEQ ID NO: 1434, SEQ ID NO: 1435, SEQ ID NO: 1436, SEQ ID NO: 1437, SEQ ID NO: 1438, SEQ ID NO: 1439, SEQ ID NO: 1440, SEQ ID NO: 1441, or SEQ ID NO: 1442."

"SEQ ID NOs: 1219-1428" refers to any one of SEQ ID NO: 1219, SEQ ID NO: 1220, SEQ ID NO: 1221, SEQ ID NO: 1222, SEQ ID NO: 1223, SEQ ID NO: 1224, SEQ ID NO: 1225, SEQ ID NO: 1226, SEQ ID NO: 1227, SEQ ID NO: 1228, SEQ ID NO: 1229, SEQ ID NO: 1230, SEQ ID NO: 1231, SEQ ID NO: 1232, SEQ ID NO: 1233, SEQ ID NO: 1234, SEQ ID NO: 1235, SEQ ID NO: 1236, SEQ ID NO: 1237, SEQ ID NO: 1238, SEQ ID NO: 1239, SEQ ID NO: 1240, SEQ ID NO: 1241, SEQ ID NO: 1242, SEQ ID NO: 1243, SEQ ID NO: 1244, SEQ ID NO: 1245, SEQ ID NO: 1246, SEQ ID NO: 1247, SEQ ID NO: 1248, SEQ ID NO: 1249, SEQ ID NO: 1250, SEQ ID NO: 1251, SEQ ID NO: 1252, SEQ ID NO: 1253, SEQ ID NO: 1254, SEQ ID NO: 1255, SEQ ID NO: 1256, SEQ ID NO: 1257, SEQ ID NO: 1258, SEQ ID NO: 1259, SEQ ID NO: 1260, SEQ ID NO: 1261, SEQ ID NO: 1262, SEQ ID NO: 1263, SEQ ID NO: 1264, SEQ ID NO: 1265, SEQ ID NO: 1266, SEQ ID NO: 1267, SEQ ID NO: 1268, SEQ ID NO: 1269, SEQ ID NO: 1270, SEQ ID NO: 1271, SEQ ID NO: 1272, SEQ ID NO: 1273, SEQ ID NO: 1274, SEQ ID NO: 1275, SEQ ID NO: 1276, SEQ ID NO: 1277, SEQ ID NO: 1278, SEQ ID NO: 1279, SEQ ID NO: 1280, SEQ ID NO: 1281, SEQ ID NO: 1282, SEQ ID NO: 1283, SEQ ID NO: 1284, SEQ ID NO: 1285, SEQ ID NO: 1286, SEQ ID NO: 1287, SEQ ID NO: 1288, SEQ ID NO: 1289, SEQ ID NO: 1290, SEQ ID NO: 1291, SEQ ID NO: 1292, SEQ ID NO: 1293, SEQ ID NO: 1294, SEQ ID NO: 1295, SEQ ID NO: 1296, SEQ ID NO: 1297, SEQ ID NO: 1298, SEQ ID NO: 1299, SEQ ID NO: 1300, SEQ ID NO: 1301, SEQ ID NO: 1302, SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1310, SEQ ID NO: 1311, SEQ ID NO: 1312, SEQ ID NO: 1313, SEQ ID NO: 1314, SEQ ID NO: 1315, SEQ ID NO: 1316, SEQ ID NO: 1317, SEQ ID NO: 1318, SEQ ID NO: 1319, SEQ ID NO: 1320, SEQ ID NO: 1321, SEQ ID NO: 1322, SEQ ID NO: 1323, SEQ ID NO: 1324, SEQ ID NO: 1325, SEQ ID NO: 1326, SEQ ID NO: 1327, SEQ ID NO: 1328, SEQ ID NO: 1329, SEQ ID NO: 1330, SEQ ID NO: 1331, SEQ ID NO: 1332, SEQ ID NO: 1333, SEQ ID NO: 1334, SEQ ID NO: 1335, SEQ ID NO: 1336, SEQ ID NO: 1337, SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344, SEQ ID NO: 1345, SEQ ID NO: 1346, SEQ ID NO: 1347, SEQ ID NO: 1348, SEQ ID NO: 1349, SEQ ID NO: 1350, SEQ ID NO: 1351, SEQ ID NO: 1352, SEQ ID NO: 1353, SEQ ID NO: 1354, SEQ ID NO: 1355, SEQ ID NO: 1356, SEQ ID NO: 1357, SEQ ID NO: 1358, SEQ ID NO: 1359, SEQ ID NO: 1360, SEQ ID NO: 1361, SEQ ID NO: 1362, SEQ ID NO: 1363, SEQ ID NO: 1364, SEQ ID NO: 1365, SEQ ID NO: 1366, SEQ ID NO: 1367, SEQ ID NO: 1368, SEQ ID NO: 1369, SEQ ID NO: 1370, SEQ ID NO: 1371, SEQ ID NO: 1372, SEQ ID NO: 1373, SEQ ID NO: 1374, SEQ ID NO: 1375, SEQ ID NO: 1376, SEQ ID NO: 1377, SEQ ID NO: 1378, SEQ ID NO: 1379, SEQ ID NO: 1380, SEQ ID NO: 1381, SEQ ID NO: 1382, SEQ ID NO: 1383, SEQ ID NO: 1384, SEQ ID NO: 1385, SEQ ID NO: 1386, SEQ ID NO: 1387, SEQ ID NO: 1388, SEQ ID NO: 1389, SEQ ID NO: 1390, SEQ ID NO: 1391, SEQ ID NO: 1392, SEQ ID NO: 1393, SEQ ID NO: 1394, SEQ ID NO: 1395, SEQ ID NO: 1396, SEQ ID NO: 1397, SEQ ID NO: 1398, SEQ ID NO: 1399, SEQ ID NO: 1400, SEQ ID NO: 1401, SEQ ID NO: 1402, SEQ ID NO: 1403, SEQ ID NO: 1404, SEQ ID NO: 1405, SEQ ID NO: 1406, SEQ ID NO: 1407, SEQ ID NO: 1408, SEQ ID NO: 1409, SEQ ID NO: 1410, SEQ ID NO: 1411, SEQ ID NO: 1412, SEQ ID NO: 1413, SEQ ID NO: 1414, SEQ ID NO: 1415, SEQ ID NO: 1416, SEQ ID NO: 1417, SEQ ID NO: 1418, SEQ ID NO: 1419, SEQ ID NO: 1420, SEQ ID NO: 1421, SEQ ID NO: 1422, SEQ ID NO: 1423, SEQ ID NO: 1424, SEQ ID NO: 1425, SEQ ID NO: 1426, SEQ ID NO: 1427, or SEQ ID NO: 1428."

In some embodiments, a disclosed recombinant RSV F protein can include an amino acid sequence at least 80% (such as at least 90%, at least 95%, or at least 98%, or 100%) identical to any one of SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 390, SEQ ID NO: 391, SEQ ID NO: 392, SEQ ID NO: 393, SEQ ID NO: 394, SEQ ID NO: 395, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO:

405, SEQ ID NO: 406, SEQ ID NO: 407, SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, SEQ ID NO: 417, SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 437, SEQ ID NO: 438, SEQ ID NO: 439, SEQ ID NO: 440, SEQ ID NO: 441, SEQ ID NO: 442, SEQ ID NO: 443, SEQ ID NO: 444, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, SEQ ID NO: 494, SEQ ID NO: 495, SEQ ID NO: 496, SEQ ID NO: 497, SEQ ID NO: 498, SEQ ID NO: 499, SEQ ID NO: 500, SEQ ID NO: 501, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, SEQ ID NO: 587, SEQ ID NO: 588, SEQ ID NO: 589, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 698, SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, SEQ ID NO: 776, SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, SEQ ID NO: 788, SEQ ID NO: 789, SEQ ID NO: 790, SEQ ID NO: 791, SEQ ID NO: 792, SEQ ID NO: 793, SEQ ID NO: 794, SEQ ID NO: 795, SEQ ID NO: 796, SEQ ID NO: 797, SEQ ID NO: 798, SEQ ID NO: 799, SEQ ID NO: 800, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815, SEQ ID NO: 816, SEQ ID NO: 817, SEQ ID NO: 818, SEQ ID NO: 819, SEQ ID NO: 820, SEQ ID NO: 821, SEQ ID NO: 822, SEQ ID NO: 823, SEQ ID NO: 824, SEQ ID NO: 825, SEQ ID NO: 826, SEQ ID NO: 827, SEQ ID NO: 828, SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ

ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 864, SEQ ID NO: 865, SEQ ID NO: 866, SEQ ID NO: 867, SEQ ID NO: 868, SEQ ID NO: 869, SEQ ID NO: 870, SEQ ID NO: 871, SEQ ID NO: 872, SEQ ID NO: 873, SEQ ID NO: 874, SEQ ID NO: 875, SEQ ID NO: 876, SEQ ID NO: 877, SEQ ID NO: 878, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 915, SEQ ID NO: 916, SEQ ID NO: 917, SEQ ID NO: 918, SEQ ID NO: 919, SEQ ID NO: 920, SEQ ID NO: 921, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931, SEQ ID NO: 932, SEQ ID NO: 933, SEQ ID NO: 934, SEQ ID NO: 935, SEQ ID NO: 936, SEQ ID NO: 937, SEQ ID NO: 938, SEQ ID NO: 939, SEQ ID NO: 940, SEQ ID NO: 941, SEQ ID NO: 942, SEQ ID NO: 943, SEQ ID NO: 944, SEQ ID NO: 945, SEQ ID NO: 946, SEQ ID NO: 947, SEQ ID NO: 948, SEQ ID NO: 949, SEQ ID NO: 950, SEQ ID NO: 951, SEQ ID NO: 952, SEQ ID NO: 953, SEQ ID NO: 954, SEQ ID NO: 955, SEQ ID NO: 956, SEQ ID NO: 957, SEQ ID NO: 958, SEQ ID NO: 959, SEQ ID NO: 960, SEQ ID NO: 961, SEQ ID NO: 962, SEQ ID NO: 963, SEQ ID NO: 964, SEQ ID NO: 965, SEQ ID NO: 966, SEQ ID NO: 967, SEQ ID NO: 968, SEQ ID NO: 969, SEQ ID NO: 970, SEQ ID NO: 971, SEQ ID NO: 972, SEQ ID NO: 973, SEQ ID NO: 974, SEQ ID NO: 975, SEQ ID NO: 976, SEQ ID NO: 977, SEQ ID NO: 978, SEQ ID NO: 979, SEQ ID NO: 980, SEQ ID NO: 981, SEQ ID NO: 982, SEQ ID NO: 983, SEQ ID NO: 984, SEQ ID NO: 985, SEQ ID NO: 986, SEQ ID NO: 987, SEQ ID NO: 988, SEQ ID NO: 989, SEQ ID NO: 990, SEQ ID NO: 991, SEQ ID NO: 992, SEQ ID NO: 993, SEQ ID NO: 994, SEQ ID NO: 995, SEQ ID NO: 996, SEQ ID NO: 997, SEQ ID NO: 998, SEQ ID NO: 999, SEQ ID NO: 1000, SEQ ID NO: 1001, SEQ ID NO: 1002, SEQ ID NO: 1003, SEQ ID NO: 1004, SEQ ID NO: 1005, SEQ ID NO: 1006, SEQ ID NO: 1007, SEQ ID NO: 1008, SEQ ID NO: 1009, SEQ ID NO: 1010, SEQ ID NO: 1011, SEQ ID NO: 1012, SEQ ID NO: 1013, SEQ ID NO: 1014, SEQ ID NO: 1015, SEQ ID NO: 1016, SEQ ID NO: 1017, SEQ ID NO: 1018, SEQ ID NO: 1019, SEQ ID NO: 1020, SEQ ID NO: 1021, SEQ ID NO: 1022, SEQ ID NO: 1023, SEQ ID NO: 1024, SEQ ID NO: 1025, SEQ ID NO: 1026, SEQ ID NO: 1027, SEQ ID NO: 1028, SEQ ID NO: 1029, SEQ ID NO: 1030, SEQ ID NO: 1031, SEQ ID NO: 1032, SEQ ID NO: 1033, SEQ ID NO: 1034, SEQ ID NO: 1035, SEQ ID NO: 1036, SEQ ID NO: 1037, SEQ ID NO: 1038, SEQ ID NO: 1039, SEQ ID NO: 1040, SEQ ID NO: 1041, SEQ ID NO: 1042, SEQ ID NO: 1043, SEQ ID NO: 1044, SEQ ID NO: 1045, SEQ ID NO: 1046, SEQ ID NO: 1047, SEQ ID NO: 1048, SEQ ID NO: 1049, SEQ ID NO: 1050, SEQ ID NO: 1051, SEQ ID NO: 1052, SEQ ID NO: 1053, SEQ ID NO: 1054, SEQ ID NO: 1055, SEQ ID NO: 1056, SEQ ID NO: 1057, SEQ ID NO: 1058, SEQ ID NO: 1059, SEQ ID NO: 1060, SEQ ID NO: 1061, SEQ ID NO: 1062, SEQ ID NO: 1063, SEQ ID NO: 1064, SEQ ID NO: 1065, SEQ ID NO: 1066, SEQ ID NO: 1067, SEQ ID NO: 1068, SEQ ID NO: 1069, SEQ ID NO: 1070, SEQ ID NO: 1071, SEQ ID NO: 1072, SEQ ID NO: 1073, SEQ ID NO: 1074, SEQ ID NO: 1075, SEQ ID NO: 1076, SEQ ID NO: 1077, SEQ ID NO: 1078, SEQ ID NO: 1079, SEQ ID NO: 1080, SEQ ID NO: 1081, SEQ ID NO: 1082, SEQ ID NO: 1083, SEQ ID NO: 1084, SEQ ID NO: 1085, SEQ ID NO: 1086, SEQ ID NO: 1087, SEQ ID NO: 1088, SEQ ID NO: 1099, SEQ ID NO: 1100, SEQ ID NO: 1101, SEQ ID NO: 1102, SEQ ID NO: 1103, SEQ ID NO: 1104, SEQ ID NO: 1105, SEQ ID NO: 1106, SEQ ID NO: 1107, SEQ ID NO: 1108, SEQ ID NO: 1109, SEQ ID NO: 1110, SEQ ID NO: 1111, SEQ ID NO: 1112, SEQ ID NO: 1113, SEQ ID NO: 1114, SEQ ID NO: 1115, SEQ ID NO: 1116, SEQ ID NO: 1117, SEQ ID NO: 1118, SEQ ID NO: 1119, SEQ ID NO: 1120, SEQ ID NO: 1121, SEQ ID NO: 1122, SEQ ID NO: 1123, SEQ ID NO: 1124, SEQ ID NO: 1125, SEQ ID NO: 1126, SEQ ID NO: 1127, SEQ ID NO: 1128, SEQ ID NO: 1129, SEQ ID NO: 1130, SEQ ID NO: 1131, SEQ ID NO: 1132, SEQ ID NO: 1133, SEQ ID NO: 1134, SEQ ID NO: 1135, SEQ ID NO: 1136, SEQ ID NO: 1137, SEQ ID NO: 1138, SEQ ID NO: 1139, SEQ ID NO: 1140, SEQ ID NO: 1141, SEQ ID NO: 1142, SEQ ID NO: 1143, SEQ ID NO: 1144, SEQ ID NO: 1145, SEQ ID NO: 1146, SEQ ID NO: 1147, SEQ ID NO: 1148, SEQ ID NO: 1149, SEQ ID NO: 1150, SEQ ID NO: 1151, SEQ ID NO: 1152, SEQ ID NO: 1153, SEQ ID NO: 1154, SEQ ID NO: 1155, SEQ ID NO: 1156, SEQ ID NO: 1157, SEQ ID NO: 1158, SEQ ID NO: 1159, SEQ ID NO: 1160, SEQ ID NO: 1161, SEQ ID NO: 1162, SEQ ID NO: 1163, SEQ ID NO: 1164, SEQ ID NO: 1165, SEQ ID NO: 1166, SEQ ID NO: 1167, SEQ ID NO: 1168, SEQ ID NO: 1169, SEQ ID NO: 1170, SEQ ID NO: 1171, SEQ ID NO: 1172, SEQ ID NO: 1173, SEQ ID NO: 1174, SEQ ID NO: 1175, SEQ ID NO: 1176, SEQ ID NO: 1177, SEQ ID NO: 1178, SEQ ID NO: 1179, SEQ ID NO: 1180, SEQ ID NO: 1181, SEQ ID NO: 1182, SEQ ID NO: 1183, SEQ ID NO: 1184, SEQ ID NO: 1185, SEQ ID NO: 1186, SEQ ID NO: 1187, SEQ ID NO: 1188, SEQ ID NO: 1189, SEQ ID NO: 1190, SEQ ID NO: 1191, SEQ ID NO: 1192, SEQ ID NO: 1193, SEQ ID NO: 1194, SEQ ID NO: 1195, SEQ ID NO: 1196, SEQ ID NO: 1197, SEQ ID NO: 1198, SEQ ID NO: 1199, SEQ ID NO: 1200, SEQ ID NO: 1201, SEQ ID NO: 1202, SEQ ID NO: 1203, SEQ ID NO: 1204, SEQ ID NO: 1205, SEQ ID NO: 1206, SEQ ID NO: 1207, SEQ ID NO: 1208, SEQ ID NO: 1209, SEQ ID NO: 1210, SEQ ID NO: 1211, SEQ ID NO: 1212, SEQ ID NO: 1213, SEQ ID NO: 1214, SEQ ID NO: 1215, SEQ ID NO: 1216, SEQ ID NO: 1217, SEQ ID NO: 1218, SEQ ID NO: 1219, SEQ ID NO: 1220, SEQ ID NO: 1221, SEQ ID NO: 1222, SEQ ID NO: 1223, SEQ ID NO: 1224, SEQ ID NO: 1225, SEQ ID NO: 1226, SEQ ID NO: 1227, SEQ ID NO: 1228, SEQ ID NO: 1229, SEQ ID NO: 1230, SEQ ID NO: 1231, SEQ ID NO: 1232, SEQ ID NO: 1233, SEQ ID NO: 1234, SEQ ID NO: 1235, SEQ ID NO: 1236, SEQ ID NO: 1237, SEQ ID NO: 1238, SEQ ID NO: 1239, SEQ ID NO: 1240, SEQ ID NO: 1241, SEQ ID NO: 1242, SEQ ID NO: 1243, SEQ ID NO: 1244, SEQ ID NO: 1245, SEQ ID NO: 1246, SEQ ID NO: 1247, SEQ ID NO: 1248, SEQ ID NO: 1249, SEQ ID NO: 1250, SEQ ID NO: 1251, SEQ ID NO: 1252, SEQ ID NO: 1253, SEQ ID NO: 1254, SEQ ID NO: 1255, SEQ ID NO: 1256, SEQ ID NO: 1257, SEQ ID NO: 1258, SEQ ID NO: 1259, SEQ ID NO: 1260, SEQ ID NO: 1261, SEQ ID NO: 1262, SEQ ID NO: 1263, SEQ ID NO: 1264, SEQ ID NO: 1265, SEQ ID NO: 1266, SEQ ID NO: 1267, SEQ ID NO: 1268,

SEQ ID NO: 1269, SEQ ID NO: 1270, SEQ ID NO: 1271, SEQ ID NO: 1272, SEQ ID NO: 1273, SEQ ID NO: 1274, SEQ ID NO: 1275, SEQ ID NO: 1276, SEQ ID NO: 1277, SEQ ID NO: 1278, SEQ ID NO: 1279, SEQ ID NO: 1280, SEQ ID NO: 1281, SEQ ID NO: 1282, SEQ ID NO: 1283, SEQ ID NO: 1284, SEQ ID NO: 1285, SEQ ID NO: 1286, SEQ ID NO: 1287, SEQ ID NO: 1288, SEQ ID NO: 1289, SEQ ID NO: 1290, SEQ ID NO: 1291, SEQ ID NO: 1292, SEQ ID NO: 1293, SEQ ID NO: 1294, SEQ ID NO: 1295, SEQ ID NO: 1296, SEQ ID NO: 1297, SEQ ID NO: 1298, SEQ ID NO: 1299, SEQ ID NO: 1300, SEQ ID NO: 1301, SEQ ID NO: 1302, SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1310, SEQ ID NO: 1311, SEQ ID NO: 1312, SEQ ID NO: 1313, SEQ ID NO: 1314, SEQ ID NO: 1315, SEQ ID NO: 1316, SEQ ID NO: 1317, SEQ ID NO: 1318, SEQ ID NO: 1319, SEQ ID NO: 1320, SEQ ID NO: 1321, SEQ ID NO: 1322, SEQ ID NO: 1323, SEQ ID NO: 1324, SEQ ID NO: 1325, SEQ ID NO: 1326, SEQ ID NO: 1327, SEQ ID NO: 1328, SEQ ID NO: 1329, SEQ ID NO: 1330, SEQ ID NO: 1331, SEQ ID NO: 1332, SEQ ID NO: 1333, SEQ ID NO: 1334, SEQ ID NO: 1335, SEQ ID NO: 1336, SEQ ID NO: 1337, SEQ ID NO: 1338, SEQ ID NO: 1339, SEQ ID NO: 1340, SEQ ID NO: 1341, SEQ ID NO: 1342, SEQ ID NO: 1343, SEQ ID NO: 1344, SEQ ID NO: 1345, SEQ ID NO: 1346, SEQ ID NO: 1347, SEQ ID NO: 1348, SEQ ID NO: 1349, SEQ ID NO: 1350, SEQ ID NO: 1351, SEQ ID NO: 1352, SEQ ID NO: 1353, SEQ ID NO: 1354, SEQ ID NO: 1355, SEQ ID NO: 1356, SEQ ID NO: 1357, SEQ ID NO: 1358, SEQ ID NO: 1359, SEQ ID NO: 1360, SEQ ID NO: 1361, SEQ ID NO: 1362, SEQ ID NO: 1363, SEQ ID NO: 1364, SEQ ID NO: 1365, SEQ ID NO: 1366, SEQ ID NO: 1367, SEQ ID NO: 1368, SEQ ID NO: 1369, SEQ ID NO: 1370, SEQ ID NO: 1371, SEQ ID NO: 1372, SEQ ID NO: 1373, SEQ ID NO: 1374, SEQ ID NO: 1375, SEQ ID NO: 1376, SEQ ID NO: 1377, SEQ ID NO: 1378, SEQ ID NO: 1379, SEQ ID NO: 1380, SEQ ID NO: 1381, SEQ ID NO: 1382, SEQ ID NO: 1383, SEQ ID NO: 1384, SEQ ID NO: 1385, SEQ ID NO: 1386, SEQ ID NO: 1387, SEQ ID NO: 1388, SEQ ID NO: 1389, SEQ ID NO: 1390, SEQ ID NO: 1391, SEQ ID NO: 1392, SEQ ID NO: 1393, SEQ ID NO: 1394, SEQ ID NO: 1395, SEQ ID NO: 1396, SEQ ID NO: 1397, SEQ ID NO: 1398, SEQ ID NO: 1399, SEQ ID NO: 1400, SEQ ID NO: 1401, SEQ ID NO: 1402, SEQ ID NO: 1403, SEQ ID NO: 1404, SEQ ID NO: 1405, SEQ ID NO: 1406, SEQ ID NO: 1407, SEQ ID NO: 1408, SEQ ID NO: 1409, SEQ ID NO: 1410, SEQ ID NO: 1411, SEQ ID NO: 1412, SEQ ID NO: 1413, SEQ ID NO: 1414, SEQ ID NO: 1415, SEQ ID NO: 1416, SEQ ID NO: 1417, SEQ ID NO: 1418, SEQ ID NO: 1419, SEQ ID NO: 1420, SEQ ID NO: 1421, SEQ ID NO: 1422, SEQ ID NO: 1423, SEQ ID NO: 1424, SEQ ID NO: 1425, SEQ ID NO: 1426, SEQ ID NO: 1427, SEQ ID NO: 1428, SEQ ID NO: 1429, SEQ ID NO: 1430, SEQ ID NO: 1431, SEQ ID NO: 1432, SEQ ID NO: 1433, SEQ ID NO: 1434, SEQ ID NO: 1435, SEQ ID NO: 1436, SEQ ID NO: 1437, SEQ ID NO: 1438, SEQ ID NO: 1439, SEQ ID NO: 1440, SEQ ID NO: 1441, SEQ ID NO: 1442, SEQ ID NO: 1456, SEQ ID NO: 1457, SEQ ID NO: 1458, SEQ ID NO: 1459, SEQ ID NO: 1460, SEQ ID NO: 1461, SEQ ID NO: 1462, SEQ ID NO: 1463, SEQ ID NO: 1464, SEQ ID NO: 1465, SEQ ID NO: 1466, SEQ ID NO: 1467, SEQ ID NO: 1468, SEQ ID NO: 1474, SEQ ID NO: 1475, SEQ ID NO: 1476, SEQ ID NO: 1477, or SEQ ID NO: 1478 ("Sequence set F"), wherein the recombinant RSV F polypeptide specifically binds to a RSV F prefusion specific antibody (such as D25) and/or includes a RSV F prefusion specific antigenic site (such as antigenic site Ø). In several embodiments the immunogen specifically binds to the antibody or includes the antigenic site after incubation in PBS at pH 7.4 at 20° C. for 24 hours. In some embodiments, the recombinant RSV F polypeptide includes one of the sequences from Sequence set F, and further includes up to 20 (such as up to 1, 2, 3, 4, 5, 6, 7, 8, 9, 10, 11, 12, 13, 14, 15, 16, 17, 18, or 19) amino acid substitutions (such as conservative amino acid substitutions, wherein the recombinant RSV F polypeptide specifically binds to a RSV F prefusion specific antibody (such as D25) and/or includes a RSV F prefusion specific antigenic site (such as antigenic site Ø). The person of ordinary skill in the art will appreciate that the sequences listed above may include leader sequences, purification tags, protease cleavage sites to remove purification tags trimerization domains, protein nanoparticle subunit domains or other sequences that are unrelated to the recombinant RSV F protein. In several embodiments, an immunogen provided herein includes a recombinant RSV F protein of one of the above sequences but does not include the leader sequences, purification tags, protease cleavage sites to remove purification tags trimerization domains, protein nanoparticle subunit domains or other sequences that are unrelated to the recombinant RSV F protein. Nucleic acid molecules encoding these protein sequences are also provides, as are methods of using the recombinant RSV F proteins to generate an immune response to RSV in a subject, or to prevent or treat RSV infection in a subject.

III. EXAMPLES

The following examples are provided to illustrate particular features of certain embodiments, but the scope of the claims should not be limited to those features exemplified.

Example 1

Structure of Respiratory Syncytial Virus Prefusion F Trimer Bound to a Human Antibody The prefusion conformation of the respiratory syncytial virus (RSV) fusion (F) glycoprotein is the target of most RSV-neutralizing antibodies in human sera, but its metastability has hindered characterization. To overcome this obstacle, antibodies that do not bind the postfusion conformation of F and are >10-fold more potent than the prophylactic antibody palivizumab (Synagis®), were identified. The co-crystal structure for one of these antibodies, D25, in complex with the F glycoprotein reveals that D25 locks F in its prefusion state. Comparisons of prefusion and postfusion F conformations define the rearrangements required to mediate RSV entry. The D25-F glycoprotein structure reveals a new site-of-vulnerability, antigenic site Ø, at the top of the F glycoprotein that is prefusion-specific and quaternary in character. The prefusion RSV F trimer structure, along with definition of antigenic site Ø, should enable the design of improved vaccine antigens and guide new approaches for passive prevention of RSV-induced disease.

Respiratory syncytial virus (RSV) is ubiquitous, infecting nearly all children by 3 years of age (Glezen et al., *Am. J. Dis. Child.*, 140, 543 (1986)). In the US, RSV bronchiolitis is the leading cause of hospitalization in infants and a major cause of asthma and wheezing throughout childhood (Shay et al., *JAMA*, 282, 1440 (1999); Hall et al., *N. Engl. J. Med.*, 360, 588 (2009)). Globally, RSV is responsible for 66,000-199,000 deaths each year for children younger than five years of age (Nair et al., *Lancet*, 375, 1545 (2010)), and accounts for 7% of deaths among infants 1 month to 1 year old—more than any other single pathogen except malaria (Lozano et al., Lancet, 380, 2095 (2013)). The only available intervention is passive administration of the licensed monoclonal antibody palivizumab (Synagis®), which recognizes the RSV fusion (F) glycoprotein (Johnson et al., J. Infect. Dis., 176, 1215 (1997); Beeler and van Wyke Coelingh, J. Virol., 63, 2941 (1989)) and reduces incidence of severe disease (The IMpact-RSV Study Group, Pediatrics, 102, 531 (1998)). Clinical evidence that RSV F-specific antibodies can protect against disease has prompted a search for better antibodies (Collarini et al., J. Immunol., 183, 6338 (2009); Wu et al., J. Mol. Biol., 368, 652 (2007); Kwakkenbos et al., Nat. Med., 16, 123 (2010)) and a concerted effort to develop an effective vaccine (Graham, Immunol. Rev., 239, 149 (2011)).

The RSV F glycoprotein facilitates fusion of viral and cellular membranes (Walsh and Hruska, J. Virol., 47, 171 (1983)); it is a type I fusion protein, with a metastable prefusion conformation that stores folding energy, released during a structural rearrangement to a highly stable postfusion conformation. Three antigenic sites (I, II, and IV) have been found to elicit neutralizing activity (Arbiza et al., J. Gen. Virol., 73, 2225 (1992); Lopez et al., J. Virol., 72, 6922 (1998); López et al., J. Virol., 64, 927 (1990)), and all exist on the postfusion form of F as determined by structural and biophysical studies (McLellan et al., J. Virol., 85, 7788 (2011); Swanson et al., Proc. Natl. Acad. Sci. U.S.A., 108, 9619 (2011)). Absorption of human sera with postfusion F, however, fails to remove the majority of F-specific neutralizing activity, suggesting that the prefusion form may harbor novel neutralizing antigenic sites (Magro et al., Proc. Natl. Acad. Sci. U.S.A., 109, 3089 (2012)). Despite extensive effort, a homogeneous preparation of soluble prefusion RSV F has not been obtained. Thus, determination of the prefusion F structure and identification of novel F-specific antigenic sites have become converging priorities for development of new prophylactic and therapeutic antibodies and vaccines. In line with these objectives, F-specific antibodies that could neutralize RSV, but not bind to postfusion F were identified, and structure of RSV F recognized by these antibodies was defined. The results reveal the prefusion conformation of RSV F, the mechanism of neutralization for a category of remarkably potent antibodies, and atomic-level details for a prefusion-specific antigenic site that should serve as a target of improved antibody-based therapies and provide a basis for the development of effective vaccine antigens.

Two human antibodies—D25 and AM22—were determined to be ~50-fold more potent than palivizumab (FIG. 1A) for neutralizing RSV F, and which also do not bind to a soluble form of RSV F stabilized in the postfusion conformation (McLellan et al., J. Virol., 85, 7788 (2011)) (FIG. 1B). D25 and AM22 were previously disclosed (Kwakkenbos et al., Nat. Med., 16, 123 (2010); U.S. Pat. Pub. 2010/0239593; U.S. Pat. Pub. 2012/0070446). The lack of D25 and AM22 binding to the postfusion form of RSV F suggested these antibodies might recognize the metastable prefusion conformation.

Figure 5:
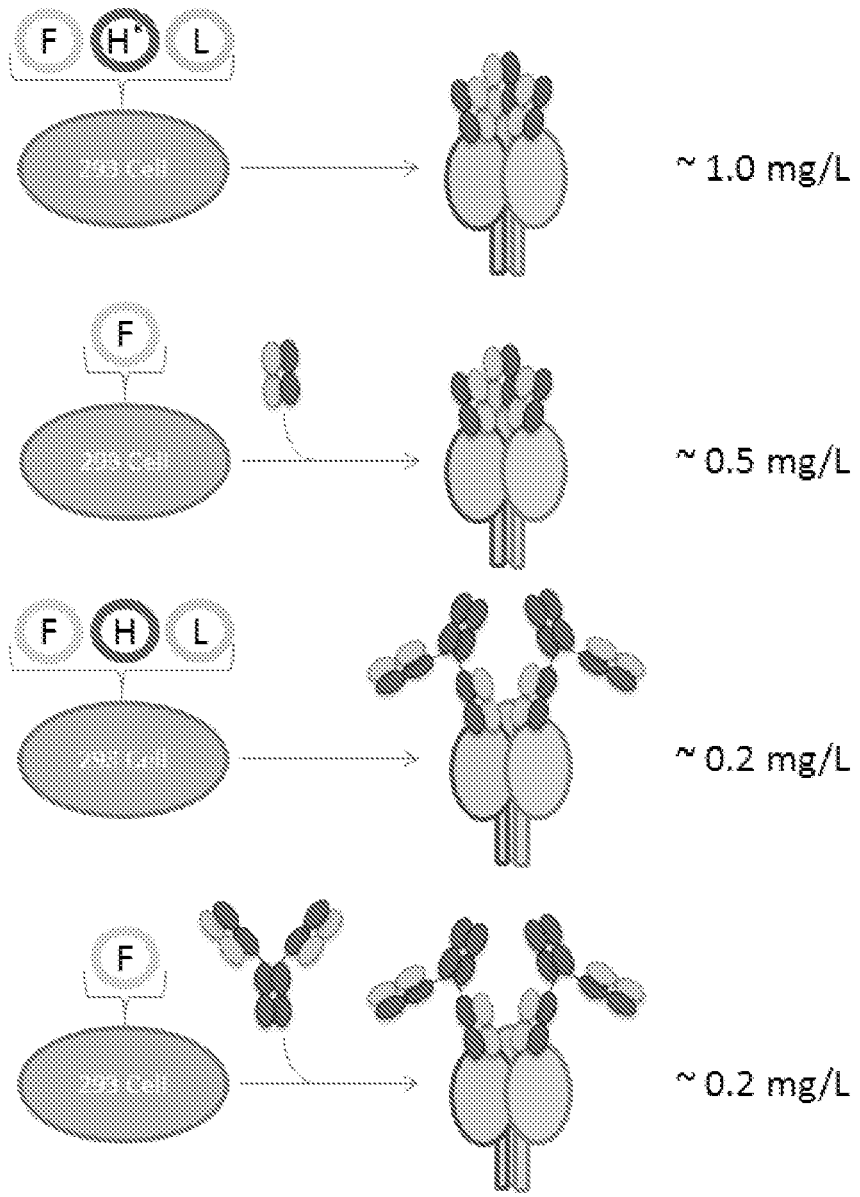
FIG. 5 shows a schematic diagram illustrating the methods used to express complexes of RSV F and D25. Plasmids expressing RSV F(+) Fd (F circle), the D25 light chain (L circle), and the D25 heavy chain (with or without a stop codon in the hinge region, H circle) were simultaneously transfected into HEK293 cells in suspension. Alternatively, the RSV F(+) Fd plasmid could be transfected, with purified D25 Fab or IgG added to the cells 3 hours post-transfection. The best yields were obtained by simultaneously expressing F and D25 Fab (~1.0 mg of purified complex per liter of cells).

Structural efforts were focused on the human antibodies, AM22 and D25. A 96-well microtiter plate expression format (Pancera et al., PLoS One. 2013; 8(2):e55701, 2013, incorporated by reference herein) was used to screen binding of these antibodies to a panel of RSV F glycoprotein variants that were captured from cell supernatants on $Ni^{2+}$-NTA ELISA plates. Antibody binding to an F glycoprotein construct (RSV F(+) Fd), comprising RSV F residues 1-513 fused to a C-terminal fibritin trimerization domain was tested (Frank et al., J. Mol. Biol., 308, 1081 (2001)). However, complexes were not formed by mixing purified RSV F(+) Fd with purified D25 or AM22 antibody. It was determined that purification of the soluble F glycoprotein triggered the metastable prefusion state (Chaiwatpongsakorn et al., J. Virol., 85, 3968 (2011)); to overcome this instability, cells expressing RSV F(+) Fd were incubated with antigen-binding fragments (Fabs) or immunoglobulins (the latter with an HRV3C protease-cleavage site in the hinge region (McLellan et al., Nature 480, 336, (2011)) in order to trap F in the prefusion state. Alternatively, cells expressing RSV F(+) Fd were cotransfected with separate DNA-expression cassettes encoding antibody-heavy and -light chains (FIG. 5). Optimal expression of a D25-F glycoprotein complex was obtained from cotransfection of DNA encoding D25 Fab with DNA encoding RSV F(+) Fd; reasonable complex yields were also observed from the addition of soluble Fab.

Crystallizations were screened for Fab D25 and AM22, alone or in complex with RSV F(+) Fd. X-ray diffraction data to 1.6 Å resolution were obtained on hexagonal crystals of Fab D25 by itself, and the structure was solved by molecular replacement and refined to $R_{cryst}/R_{free}$ of 24.5/25.7% (Table 9). Data to 3.6 Å resolution were obtained on cubic crystals of Fab D25 in complex with RSV F (+) Fd, and this structure was solved by molecular replacement using the unbound D25 structure and portions of the previously determined postfusion RSV F structure (McLellan et al., J. Virol., 85, 7788 (2011); Swanson et al., Proc. Natl. Acad. Sci. U.S.A., 108, 9619 (2011)) as search models, along with clues from a gold derivative. The structure of the complex was refined to $R_{cryst}/R_{free}$ of 21.3/26.7% (FIG. 1C) (Table 9).

A complex of one D25 Fab bound to one molecule of the RSV F glycoprotein was present in the asymmetric unit of the cubic lattice. Three-fold lattice symmetry positioned two other D25-RSV F complexes to generate an extensive RSV F trimeric interface of 2,098 Å$^2$. Continuous electron density was observed for residues 26 to 513, except for residues 98-136 that included the 27 amino-acid fragment removed by proteolytic cleavage of the $F_0$ precursor to form the $F_2$ and $F_1$ subunits (corresponding to N- and C-terminal fragments, respectively) of the mature F glycoprotein. Three sites of N-linked glycosylation were detected in the electron density at asparagine residues 27, 70 and 500 (FIG. 2A).

Overall, the D25-bound RSV F structure consists of two lobes packed at either end of a 7-stranded antiparallel open-ended barrel, two strands of which (β2 and β7) extend between the two lobes, hydrogen-bonding for over 70 Å and forming integral portions of both lobes and of the central barrel. The membrane-proximal lobe, which contains the F2 N-terminus and $F_1$ C-terminus, consists of a triple layered β-sandwich and three helices (α8, α9 and α10). Helix α10 forms part of a helix that appeared to extend into the viral membrane and to which the fibrin trimerization domain was appended. The membrane-distal lobe, approximately 90 Å from the viral membrane, consists of seven helices, packed around a three-stranded antiparallel sheet and a β-hairpin (β3+β4). Extensive inter-protomer contacts appeared to stabilize the trimeric structure, particularly the hydrophobic N-terminus of the $F_1$ subunit (also known as the fusion peptide), which was cradled by the triple β-sandwich from the membrane-proximal lobe of a neighboring protomer. The fusion peptide, contained within the otherwise hollow cavity of the trimer, is connected to the surface-exposed α2 and α3 helices through a cylindrical opening between the protomers that is roughly 10 Å in diameter; this opening may be used as an exit path for the fusion peptide during triggering.

Figure 6:
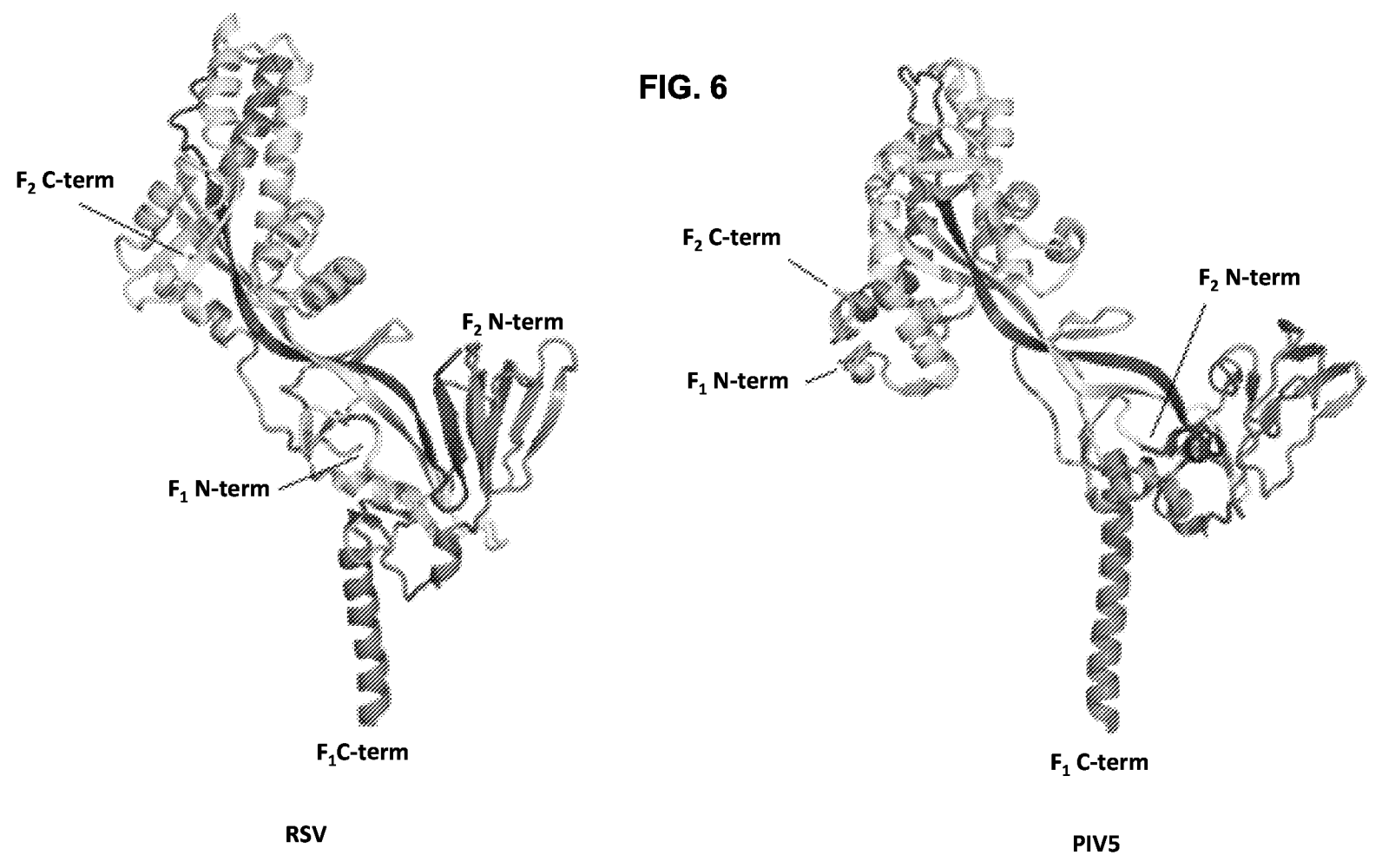
Figure 7:
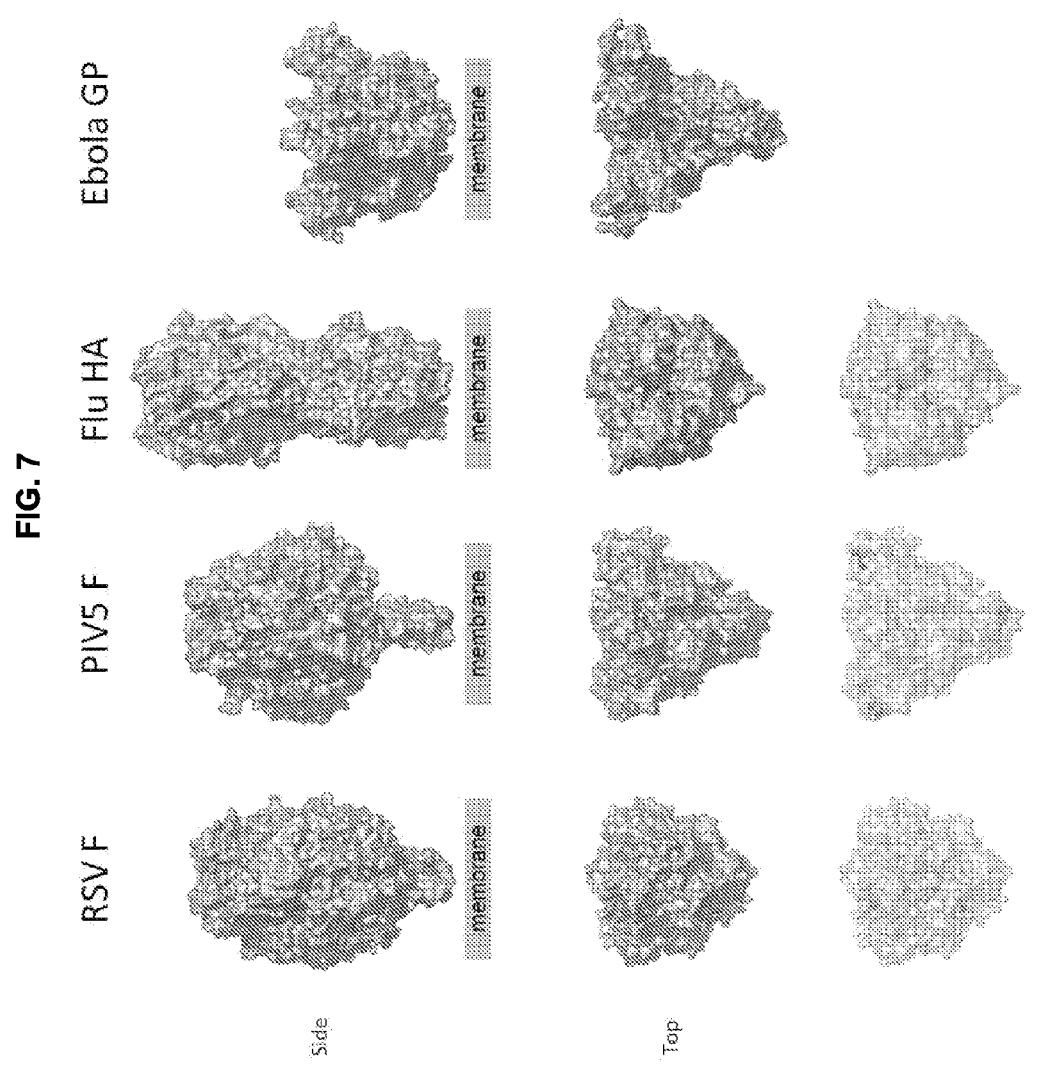

The structure of the D25-bound F glycoprotein resembled the prefusion structure of the related parainfluenza virus 5 (PIV5) F glycoprotein (Welch et al., *Proc. Natl. Acad. Sci. U.S.A.,* 109, 16672 (2012); Yin et al., *Nature,* 439, 38 (2006)) (FIGS. 6 and 7). The D25-bound form of RSV F thus appeared to be in the prefusion conformation (FIG. 2). To define the structural rearrangements between pre- and postfusion F, D25-bound form of RSV F was compared with its postfusion conformation, which was recently determined (McLellan et al., *J. Virol.,* 85, 7788 (2011); Swanson et al., *Proc. Natl. Acad. Sci. U.S.A.,* 108, 9619 (2011).

Pre- and post-fusion conformations of RSV F revealed dramatic changes in overall shape, from a relatively compact oval-shaped structure with a height of 110 Å to an extended cone approximately 50% longer (170 Å) (FIG. 2A). Despite this remarkable change in conformation, the majority of the F glycoprotein secondary and tertiary structure was preserved in both pre- and post-fusion states, with 215 residues showing less than 2 Å Cα deviation between the two structures (FIGS. 2A,B). Two regions of striking conformational change occur. In the membrane-distal lobe, the fusion peptide and five secondary structure elements (α2, α3, β3, β4, and α4) join with the α5-helix to form a single extended postfusion helix ($\alpha 5_{post}$) of over 100 Å in length, which is capped at its N-terminus by the fusion peptide (to aid in clarity, secondary structure elements of the postfusion structure are labeled with "post" subscript). In the membrane-proximal lobe, the sole parallel strand β22) of the triple β-sandwich—which in the prefusion structure hydrogen bonds to β1—unravels, allowing the prefusion α10-helix to join with the $\alpha 5_{post}$-helix. Together, the $\alpha 5_{post}$ and $\alpha 10_{post}$ helices juxtapose $F_1$ N- and C-termini to form the coiled-coil structure characteristic of type I fusion proteins in their postfusion conformation (Colman and Lawrence, *Nat. Rev. Mol. Cell Biol.,* 4, 309 (2003)). Overall, portions of the α10 helix move more than 170 Å between pre- and post-fusion conformations.

In comparison to the previously reported protease-cleaved, prefusion type I structures of influenza hemagglutinin (Wilson et al., *Nature,* 289, 366 (1981)), Ebola GP (Lee et al., *Nature,* 454, 177 (2008)) and PIV5 F (Welch et al., *Proc. Natl. Acad. Sci. U.S.A.,* 109, 16672 (2012)), the location of the RSV fusion peptide is most similar to that of hemagglutinin (FIG. 7), which is surprising given that PIV5 and RSV are both paramyxoviruses. The RSV F fusion peptide is buried in the center of the hollow trimer cavity, and is located more than 40 Å away from the last visible F2 residue. This suggests that a substantial structural rearrangement of the fusion peptide occurs after the $F_0$ precursor is cleaved by the furin-like host protease to produce $F_1/F_2$. In addition, dramatic structural rearrangements occur between pre- and post-fusion conformations in both the membrane-proximal and membrane-distal lobes, providing insight into the difficulty of stabilizing the prefusion conformation of RSV F. Unlike PIV5 F and human metapneumovirus F, which can be stabilized in the prefusion state solely by appending a GCN4-trimerization motif to the C-terminus (Yin et al., *Nature,* 439, 38 (2006); Wen et al., *Nat. Struct. Mol. Biol.,* 19, 461 (2012)), the prefusion RSV F conformation requires stabilization of both the membrane-proximal lobe (accomplished by appending a fibritin trimerization domain (Frank et al., *J. Mol. Biol.,* 308, 1081 (2001)) and the membrane-distal lobe (which occurs through binding of the D25 antibody).

Figure 1C:
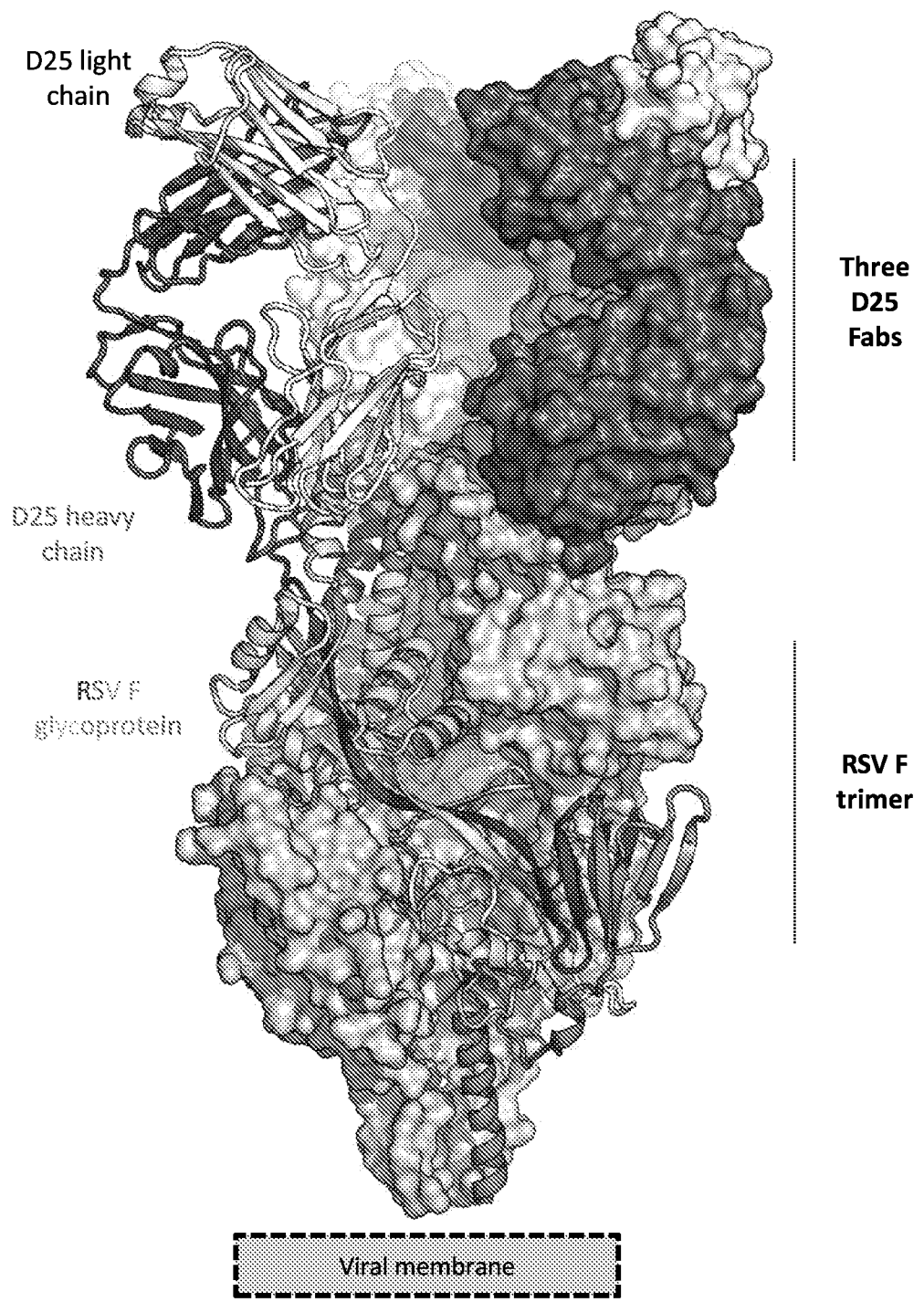

The D25 antibody recognizes the membrane-distal apex of the RSV F glycoprotein (FIG. 1C). It binds to a quaternary epitope, with the D25-heavy chain interacting with one protomer (involving 638 Å$^2$ of buried interactive-surface area on RSV) and the D25-light chain binding to both the same protomer (373 Å$^2$) and a neighboring protomer (112 Å$^2$) (FIG. 3A). RSV F contacts are made by 5 of the 6 complementarity-determining loops of D25, with the heavy chain 3rd CDR (CDR H3) interacting with the α4-helix ($F_1$ residues 196-210) and forming intermolecular hydrogen bonds with F2 residues 63, 65, 66 and 68 in the loop between strand β2 and helix α1. While the secondary structural elements of the D25 epitope remain mostly unchanged, their relative orientation changes substantially, with α4-helix pivoting ~180° relative to strand β2 in pre- and post-fusion conformations (FIG. 3B). This structural rearrangement explains the failure of D25 to bind postfusion F molecules and suggests D25 inhibits membrane fusion by stabilizing the prefusion conformation of the trimeric F glycoprotein complex. Although F proteins from human RSV A and B subtypes are highly related in sequence (447/472 or 94.7% of the amino acids comprising the mature F2/$F_1$ ectodomain are identical between known subtypes), six naturally observed positions of RSV-sequence variation (residues 67 and 74 in F2, and residues 200, 201, 209, and 213 in $F_1$) are located in the region bound by D25 (FIG. 3C). Similarly, of the 56 amino acids in bovine RSV F that are not identical to the mature ectodomain of human RSV F subtype A, 13 are found in this same region (FIG. 3C). Thus, the D25 epitope, at the apex of the prefusion RSV F structure, may be under immune pressure and serve as a determinant of subtype-specific immunity (Chambers et al., *J. Gen. Virol.,* 73, 1717 (1992)). For example, based on sequence analysis, a loop region in F glycoproteins was hypothesized to exist within the Paramyxoviridae family that might be under immune pressure (Chambers et al., *J. Gen. Virol.,* 73, 1717 (1992)). It has been demonstrated that binding of RSV sub-group specific monoclonal antibodies can be affected by site-directed mutations between F1 residues 200 and 216 (Connor et al., *J. Med. Virol.,* 63, 168 (2001)), and that a peptide comprising F1 residues 205-225 could elicit neutralizing activity in rabbits, although a specific epitope was not defined (Corvaisier et al., *Arch. Virol.,* 142, 1073 (1997)).

Figure 4A:
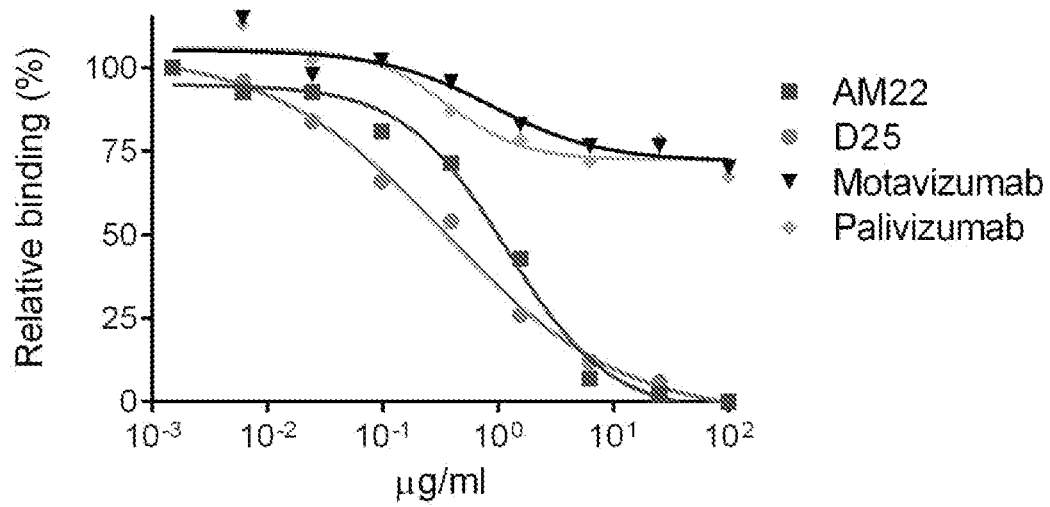
FIGS. 4A-4D are series of graphs and digital images concerning antigenic site Ø. Highly effective RSV-neutralizing antibodies target a site at the membrane-distal apex of the prefusion F trimer. (A) The ability of antibodies to block D25 binding to RSV-infected cells was measured as a function of antibody concentration. (B) Analysis of RSV F/Fab complexes by negative stain electron microscopy: (Left) Reprojection of a 12 Å slice through the crystal structure of RSV F+D25 Fab filtered to 10 Å resolution and sliced to include the F-trimer cavity. (Middle) Aligned average of 263 particles of RSV F+D25 Fab. (Right) Aligned average of 550 particles of RSV F+AM22 Fab. Scale bar in middle panel is 50 Å. (C) Fusion inhibition and (D) attachment inhibition activity for antibodies targeting antigenic site Ø and F-specific antibodies targeting other antigenic sites. For the attachment-inhibition assay, heparin was used as a positive control.
Figure 4B:
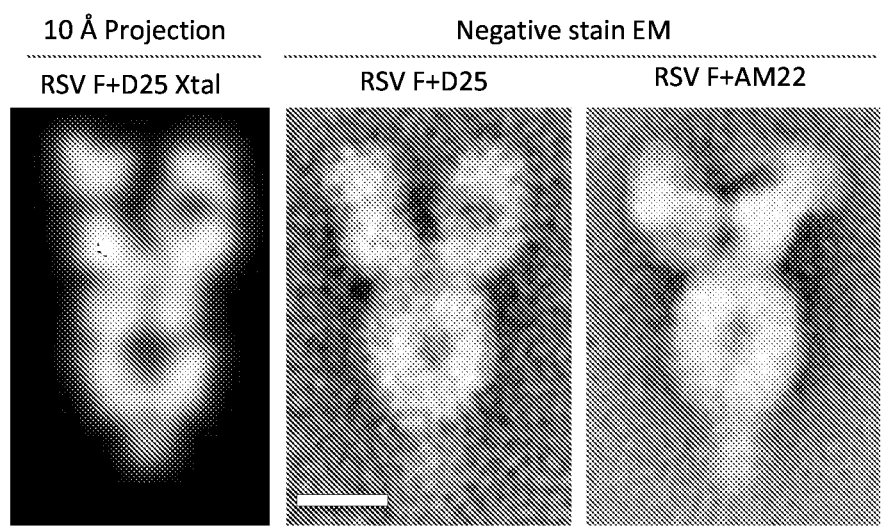

To understand the relationship of the D25 epitope relative to epitopes recognized by other RSV-neutralizing antibodies, competition for D25 binding to RSV-infected cells was tested (FIG. 4A). Notably, AM22 competed with D25 for RSV F binding, suggesting that they recognized the same antigenic site. To further define the site recognized by these antibodies, negative stain EM on Fab-RSV F complexes was performed. EM images of Fab D25-RSV F complexes resembled the crystal structure of Fab D25-RSV F, and also EM images of Fab AM22-RSV F (FIG. 4B). Together, these results suggested antibodies D25 and AM22 recognize the same or a highly related antigenic site, which was named "antigenic site Ø".

Figure 4C:
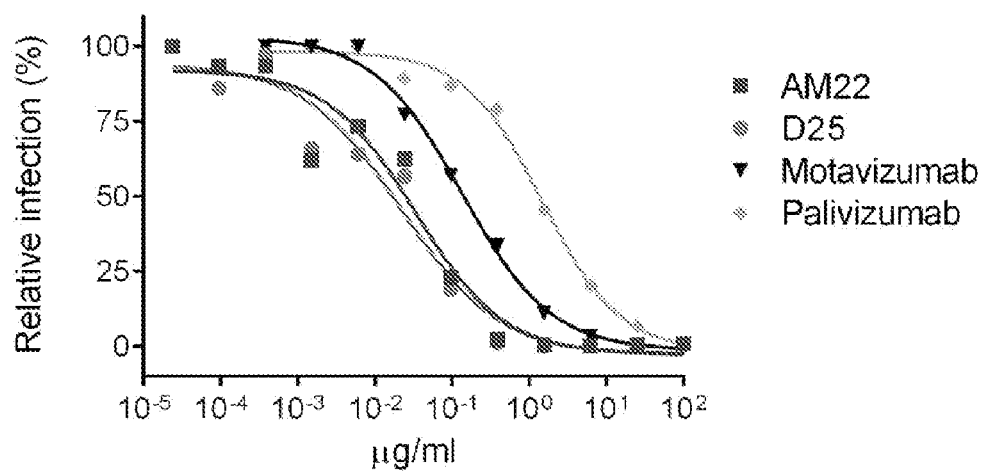
Figure 4D:
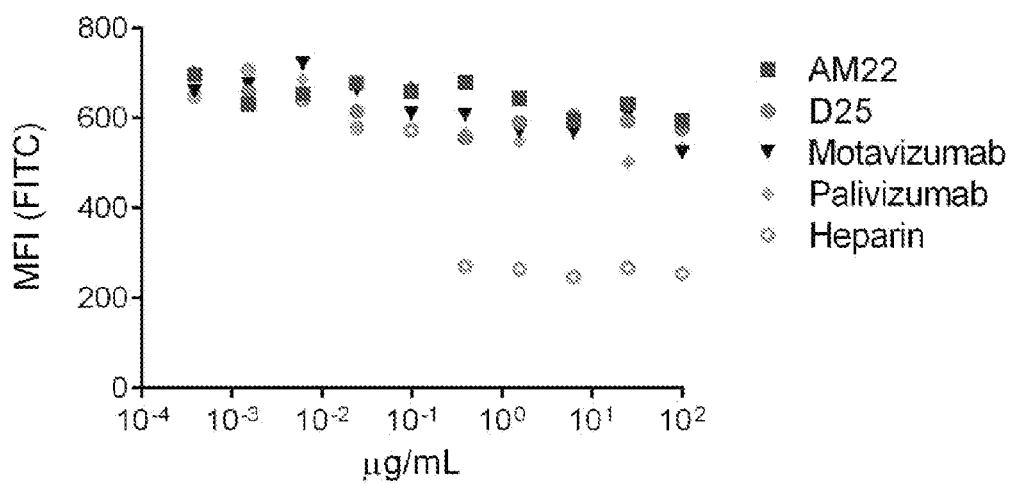
Figure 9B:
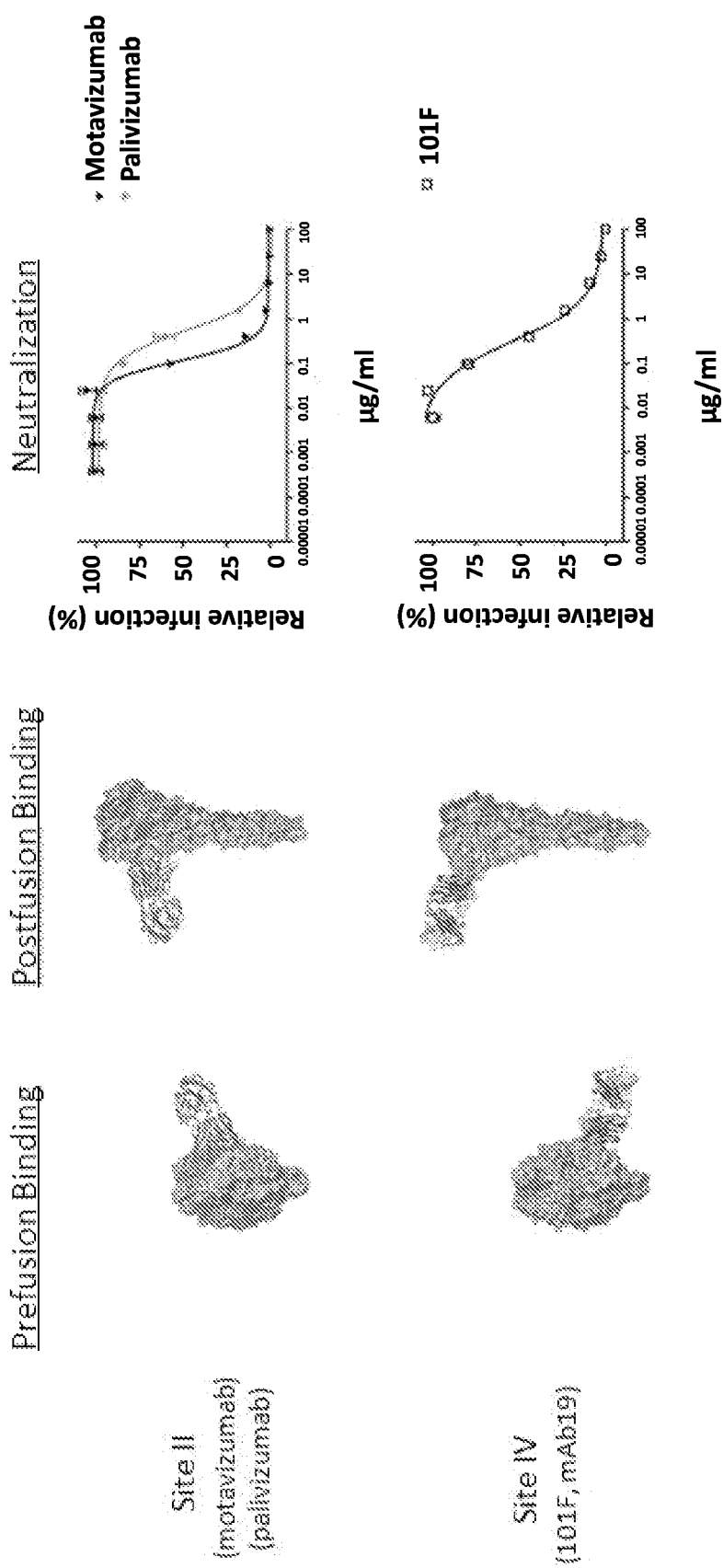

To characterize antibodies that recognize antigenic site Ø, their functional properties were examined. In addition to their extraordinary potency and prefusion-specificity (FIG. 1A), all three antibodies strongly inhibited fusion when added post-attachment (FIG. 4C), and all three were unable to block cell-surface attachment (FIG. 4D), suggesting that the RSV F receptor binds to a region on F not blocked by these three antibodies. The receptor-binding domain on the related human metapneumovirus F protein is an RGD motif (Cseke et al., *Proc. Natl. Acad. Sci. U.S.A.,* 106, 1566 (2009)) that corresponds to RSV F residues 361-363, which reside at the tip of a loop of the central barrel, on the side of the prefusion RSV F trimer not blocked by D25-binding. Although these antibodies do not prevent attachment, the regions of both F2 and F1 comprising antigenic site Ø are known to contribute to heparin binding (Feldman et al., *J. Virol.*, 74, 6442 (2000); Crim et al., *J. Virol.*, 81, 261 (2007)), and it is possible that this region may contribute to non-specific attachment to heparin sulfate moieties on glycosaminoglycans in concert with the G glycoprotein and other regions of F. Lastly, AM22 and D25 antibodies neutralized similarly in both Fab and immunoglobulin contexts (FIG. 8), indicating that avidity did not play a dominant role as it does for some influenza-virus antibodies (Ekiert et al., *Nature*, 489, 526 (2012)). Overall, the shared binding-specificity and neutralization phenotypes of D25 and AM22 and suggest that these properties may be characteristic of antibodies that recognize antigenic site Ø. By contrast, none of the antibodies that recognize other antigenic sites on RSV F associated with neutralizing activity (sites I, II, and IV) share similar properties of neutralizing potency and prefusion F specificity (FIGS. 9A-9B).

Despite antigenic site Ø being partially shielded from immune recognition by multiple mechanisms including conformational masking (it is only present in the metastable prefusion state), quaternary assembly (the site is shared by RSV protomers), antigenic variation (it is one of the most variable portions of RSV F), and glycan shielding (the N-linked glycan attached to Asn70 is at the top of the prefusion F trimer), all three prefusion-specific antibodies appear to target a similar epitope. The location of antigenic site Ø at the apex of the prefusion F trimer should be readily accessible even on the crowded virion surface, which may explain the observation that most neutralizing activity in human sera induced by natural RSV infection is directed against the prefusion form of RSV F (Magro et al., *Proc. Natl. Acad. Sci. U.S.A.*, 109, 3089 (2012), although other prefusion-specific antigenic sites cannot be ruled out. The high potency of antibodies against antigenic site Ø suggests they could be developed for passive prophylaxis of RSV-induced disease in neonates. Also, vaccine-based prefusion-specific antibody elicitation may be assisted by stabilization of the prefusion form of RSV F, perhaps facilitated by linking mobile and immobile portions of the F structure through structure-based design of RSV F variants with disulfide bonds. It is noted that prefusion-stabilized F contains all of the previously characterized neutralizing epitopes as well as antigenic site Ø. Definition of the D25-RSV F structure thus provides the basis for multiple new approaches to prevent RSV-induced disease.

Materials and Methods

Viruses and Cells.

Viral stocks were prepared and maintained as previously described (Graham et al., *J. Med. Virol.*, 26, 153 (1988)) RSV-expressing Green Fluorescent Protein (GFP) RSV-GFP was constructed as previously reported (Hallak et al., Virology. 271, 264 (2000)). The titer of the RSV-GFP stocks used for flow cytometry-based neutralization and fusion assays was $2.5 \times 10^7$ pfu/ml. The titer of the RSV A2 stock used for attachment assay was $1.02 \times 10^8$ pfu/ml. HEp-2 cells were maintained in Eagle's minimal essential medium containing 10% fetal bovine serum (10% EMEM) and were supplemented with glutamine, penicillin and streptomycin.

Creation of Antibody Expression Plasmids.

DNA encoding antibody heavy and light variable regions were codon-optimized for human expression and synthesized. AM22 and D25 heavy and light variable regions were subcloned into pVRC8400 expression plasmids containing in-frame human constant domains (IgG1 for heavy chain and kappa for light chain). Variants of the AM22 and D25 heavy chain expression plasmids were made by inserting either an HRV3C protease site (GLEVLFQGP; SEQ ID NO: 355) or a stop codon into the hinge region.

Expression and Purification of Antibodies and Fab Fragments.

Antibodies were expressed by transient co-transfection of heavy and light chain plasmids into HEK293F cells in suspension at 37° C. for 4-5 days. The cell supernatants were passed over Protein A agarose, and bound antibodies were washed with PBS and eluted with IgG elution buffer into ¹⁄₁₀th volume of 1 M Tris-HCl pH 8.0. AM22 and D25 Fabs were created by digesting the IgG with Lys-C. The digestion was inhibited by the addition of Complete protease inhibitor cocktail tablets, and the Fab and Fc mixtures was passed back over Protein A agarose to remove Fc fragments. The Fab that flowed through the column was further purified by size exclusion chromatography.

RSV Neutralization Assays.

Antibody-mediated neutralization was measured by a flow cytometry neutralization assay (Chen et al., *J. Immunol. Methods*, 362, 180 (2010). Briefly, HEp-2 cells were infected with RSV-GFP and infection was monitored as a function of GFP expression at 18 hours post-infection by flow cytometry. Data were analyzed by curve fitting and non-linear regression (GraphPad Prism, GraphPad Software Inc., San Diego Calif.).

Postfusion RSV F-Binding Assay.

Purified, soluble RSV F protein in the postfusion conformation was prepared as described in (McLellan et al., *J. Virol.*, 85, 7788 (2011). A kinetic ELISA was used to test binding of monoclonal antibodies to postfusion RSV F as described previously (McLellan et al., *J. Mol. Biol.*, 409, 853 (2011). Briefly, 96-well $Ni^{2+}$-NTA-coated plates (Thermo-Fisher Scientific) were coated with 100 µl postfusion RSV F (1 µg/ml) for one hour at room temperature. 100 µl of diluted antibody was added to each well and incubated for one hour at room temperature. Bound antibodies were detected by incubating the plates with 100 µl HRP-conjugated goat anti-mouse IgG antibody (Jackson ImmunoResearch Laboratories, West Grove, Pa.) or HRP-conjugated anti-human IgG (Santa Cruz Biolotechnology, Inc, Santa Cruz, Calif.) for 1 hour at room temperature. Then, 100 µl of Super AquaBlue ELISA substrate (eBioscience, San Diego Calif.) was added to each well and plates were read immediately using a Dynex Technologies microplate reader at 405 nm (Chantilly, Va.). Between steps, plates were washed with PBS-T.

Crystallization and X-Ray Data Collection of Unbound D25 Fab.

Crystallization conditions were screened using a Cartesian Honeybee crystallization robot, and initial crystals were grown by the vapor diffusion method in sitting drops at 20° C. by mixing 0.2 µl of D25 Fab with 0.2 µl of reservoir solution (22% (w/v) PEG 4000, 0.1 M sodium acetate pH 4.6). Crystals were manually reproduced in hanging drops by combining protein and reservoir solution at a 2:1 ratio. Crystals were flash frozen in liquid nitrogen in 27.5% (w/v) PEG 4000, 0.1 M sodium acetate pH 4.5, and 15% (v/v) 2R,3R-butanediol. X-ray diffraction data to 1.6 Å were collected at a wavelength of 1.00 Å at the SER-CAT beamline ID-22 (Advanced Photon Source, Argonne National Laboratory).

Structure Determination and Refinement of Unbound D25 Fab.

X-ray diffraction data were integrated and scaled with the HKL2000 suite (Otwinowski and Minor, in Methods Enzymol. (Academic Press, vol. 276, pp. 307-326, 1997)), and a molecular replacement solution using Ig domains from PDB ID: 3GBM (Ekiert et al., *Science,* 324, 246 (2009)) and 3IDX (Chen et al., *Science,* 326, 1123 (2009)) as search models was obtained using PHASER (McCoy et al., *J. Appl. Crystallogr.,* 40, 658 (2007)). Manual model building was carried out using COOT (Emsley et al., *Acta Crystallogr D Biol Crystallogr,* 66, 486 (2010)), and refinement of individual sites, TLS parameters, and individual B-factors was performed in PHENIX (Adams et al., *Acta Crystallogr D Biol Crystallogr,* 66, 213 (2010)). The electron density for the D25 variable domains was excellent, but the electron density for the constant domains was poor, possibly a result of flexibility in the elbow angle. Final data collection and refinement statistics are presented in Table 8.

Expression and Purification of RSV F(+) Fd in Complex with D25 Fab.

The RSV F (+) Fd protein construct was derived from the A2 strain (accession P03420) with three naturally occurring substitutions (P102A, I379V, and M447V) to enhance expression. A mammalian codon-optimized gene encoding RSV F residues 1-513 with a C-terminal T4 fibritin trimerization motif (Frank et al., *J. Mol. Biol.,* 308, 1081 (2001)), thrombin site, 6×His-tag, and StreptagII was synthesized and subcloned into a mammalian expression vector derived from pLEXm (Aricescu et al., *Acta Crystallogr D Biol Crystallogr,* 62, 1243 (2006)). Plasmids expressing RSV F(+) Fd, the D25 light chain, and the D25 heavy chain (with or without a stop codon in the hinge region) were simultaneously transfected into HEK293 GnTI$^{-/-}$ cells (Reeves et al., *Proc. Natl. Acad. Sci. U.S.A.,* 99, 13419 (2002)) in suspension. Alternatively, just the RSV F(+) Fd plasmid could be transfected, with purified D25 Fab added to the GnTI$^{-/-}$ cells 3 hours post-transfection. After 4-5 days, the cell supernatant was harvested, centrifuged, filtered and concentrated. The complex was initially purified via Ni$^{2+}$-NTA resin (Qiagen, Valencia, Calif.) using an elution buffer consisting of 20 mM Tris-HCl pH 7.5, 200 mM NaCl, and 250 mM imidazole pH 8.0. The complex was then concentrated and further purified over StrepTactin resin as per the manufacturer's instructions (Novagen, Darmstadt, Germany). After an overnight incubation with thrombin protease (Novagen) to remove the His and Strep tags, an excess of D25 Fab was added to the complex, which was then purified on a Superose6 gel filtration column (GE Healthcare) with a running buffer of 2 mM Tris-HCl pH 7.5, 350 mM NaCl, and 0.02% NaN$_3$. The eluted complex was diluted with an equal volume of water and concentrated to ~5 mg/ml. Similar procedures were used to express and purify AM22 Fab complexes.

Crystallization and X-Ray Data Collection of RSV F(+) Fd in Complex with D25 Fab.

Initial crystals were grown by the vapor diffusion method in sitting drops at 20° C. by mixing 0.1 µl of RSV F(+) Fd bound to D25 Fab with 0.1 µl of reservoir solution (40% (w/v) PEG 400, 5% (w/v) PEG 3350, and 0.1 M sodium acetate pH 5.5) (Majeed et al., *Structure,* 11, 1061 (2003)). Crystals were manually reproduced in hanging drops, and the crystal that diffracted to 3.6 Å was grown using a reservoir solution containing 30% (w/v) PEG 400, 3.75% (w/v) PEG 3350, 0.1 M HEPES pH 7.5, and 1% (v/v) 1,2-butanediol. The crystal was directly transferred from the drop into the cryostream, and X-ray diffraction data were collected remotely at a wavelength of 1.00 Å at the SER-CAT beamline ID-22.

Structure Determination and Refinement of RSV F(+)Fd in Complex with D25 Fab.

X-ray diffraction data were integrated and scaled with the HKL2000 suite (Otwinowski and Minor, in Methods Enzymol. (Academic Press, vol. 276, pp. 307-326, 1997)), and a molecular replacement solution was obtained by PHASER (McCoy et al., *J. Appl. Crystallogr.,* 40, 658 (2007)) using the unbound D25 Fab structure and residues 29-42, 49-60, 78-98, 219-306, 313-322, 333-343, and 376-459 from the postfusion RSV F structure (PDB ID: 3RRR, McLellan et al., *J. Virol.,* 85, 7788 (2011)) as search models. Six sites from a NaAuCl$_4$ derivative mapped to known reactive side chains (F residues Met97/His159, Met264/Met274, His317, and Met396; D25 heavy chain residues Met19/His82 and His 59). Manual model building was carried out using COOT (Emsley et al., *Acta Crystallogr D Biol Crystallogr,* 66, 486 (2010)), with secondary structure elements being built first. Refinement of individual sites, TLS parameters, and individual B-factors was performed in PHENIX (Adams et al., *Acta Crystallogr D Biol Crystallogr,* 66, 213 (2010)), using the unbound D25 Fab structure, and portions of the postfusion RSV F structure as reference models during the refinement. All RSV F residues in the mature protein were built except for those residues in F2 C-terminal to Met97. Final data collection and refinement statistics are presented in Table 9.

RSV F Competition Binding Assay.

Competition binding of antibodies was performed on RSV infected HEp-2 cells. HEp-2 cells were infected with 3 MOI (multiplicity of infection) of RSV for 18-20 hours. After infection, cells were separated using cell dissociation solution (Cellstripper, Mediatech Inc., Herndon, Va.), and washed with PBS. Cells were seeded at 5×10$^4$/well in 96-well U-bottom plates in PBS. Monoclonal antibodies AM22, D25, and 101F were diluted starting at a concentration of 100 µg/ml, and added to HEp-2 cells. After 30 minutes 100 ul of Alexa 488 conjugated D25 was added at a concentration of 1 µg/ml and incubated at 4° C. for one hour. Cells were washed once with PBS, and then fixed with 0.5% paraformaldehyde. The binding of D25-Alexa 488 on cells was measured by flow cytometry (LSR II instrument, Becton Dickinson, San Jose, Calif.). Data were analyzed by using FlowJo software, version 8.5 (Tree Star, San Carlos, Calif.).

Negative Staining Electron Microscopy Analysis.

Samples were adsorbed to freshly glow-discharged carbon-coated grids, rinsed shortly with water, and stained with freshly made 0.75% uranyl formate. Images were recorded on an FBI T20 microscope with an Eagle CCD camera. Image analysis and 2D averaging was performed with Bsoft (Heymann and Belnap, *J. Struct. Biol.,* 157, 3 (2007) and EMAN (Ludtke et al., *J. Struct. Biol.,* 128, 82 (1999)).

RSV Virus-to-Cell Fusion Inhibition Assay.

The ability of antibodies to inhibit RSV virus-to-cell fusion was measured as described previously (McLellan et al., *J. Virol.,* 84, 12236 (2010)). Briefly, HEp-2 cells were seeded in 96-well plates, cultured for 24 hours at 37° C., and then chilled at 4° C. for one hour prior to assay. RSV-GFP was added to pre-chilled cells at 4° C., and then cells were washed in cold PBS to remove unbound virus. Serially-diluted antibodies were added to chilled cells and incubated for 1 hour at 4° C., before transferring to 37° C. for 18 hours. After incubation, cells were trypsinized, fixed in 0.5% paraformaldehyde, and analyzed by flow cytometry to determine the frequency of GFP-expressing cells.

RSV Attachment Inhibition Assay.

The ability of antibodies to inhibit RSV attachment to cells was measured as described previously (McLellan et al., J. Virol., 84, 12236 (2010)). Briefly, HEp-2 cells were dispersed into media, washed with cold PBS, seeded in 96-well v-bottom plates, and chilled for 1 hour at 4° C. before use. Antibodies and heparin, a known RSV attachment inhibitor, were distributed in serial dilutions, then mixed with RSV A2 strain virus for one hour at 37° C. Medium from chilled cells was removed after centrifugation and virus or mixtures of virus and reagents were added to chilled cells and incubated for 1 hour at 4° C. After incubation, cells were washed in cold PBS to remove unbound virus, and fixed with 0.5% paraformaldehyde. Viruses bound on cells were detected with FITC-conjugated goat anti-RSV antibody. Cells were washed in cold PBS and evaluated by flow cytometry. Median fluorescence intensities of bound virus were analyzed with FlowJo software, version 8.5 (Tree Star, San Carlos, Calif.).

TABLE 9

Crystallographic data collection and refinement statistics.

|  | D25 Fab | D25 Fab + RSV F |
|---|---|---|
| Data collection |  |  |
| Space group | $P6_122$ | $P2_13$ |
| Cell constants |  |  |
| a, b, c (Å) | 108.7, 108.7, 139.9 | 152.3, 152.3, 152.390.0, |
| α, β, γ (°) | 90.0, 90.0, 120.0 | 90.0, 90.0 |
| Wavelength (Å) | 1.00 | 1.00 |
| Resolution (Å) | 50.0-1.6 (1.63-1.60) | 50.0-3.6 (3.73-3.60) |
| $R_{merge}$ | 11.2 (68.0) | 12.7 (81.4) |
| I/σI | 27.3 (2.1) | 16.4 (2.0) |
| Completeness (%) | 98.3 (86.1) | 99.6 (99.3) |
| Redundancy | 11.0 (5.3) | 6.5 (5.2) |
| Refinement |  |  |
| Resolution (Å) | 35.4-1.6 (1.62-1.60) | 42.2-3.6 (3.88-3.60) |
| Unique reflections | 63,360 (2,241) | 13,877 (2,742) |
| $R_{work}/R_{free}$ (%) | 24.1/25.5 | 21.3/26.7 |
| No. atoms |  |  |
| Protein | 3,305 | 6,778 |
| Ligand/ion | 0 | 0 |
| Water | 270 | 0 |
| B-factors (Å$^2$) |  |  |
| Protein | 53.0 | 128.1 |
| Ligand/ion | — | — |
| Water | 44.1 | — |
| R.m.s. deviations |  |  |
| Bond lengths (Å) | 0.007 | 0.003 |
| Bond angles (°) | 1.20 | 0.91 |
| Ramachandran |  |  |
| Favored (%) | 96.5 | 92.0 |
| Allowed (%) | 3.0 | 7.3 |
| Outliers (%) | 0.5 | 0.7 |

Example 2

Stabilization of RSV F Proteins

This example illustrates design of exemplary RSV F proteins stabilized in a prefusion conformation. The crystal structure of the RSV F protein in complex with D25 Fab (i.e., in a prefusion conformation) compared to the structure of the postfusion RSV F protein (disclosed, e.g., in McLellan et al., J. Virol., 85, 7788, 2011, with coordinates deposited as PDB Accession No. 3RRR) shows dramatic structural rearrangements between pre- and post-fusion conformations in both the membrane-proximal and membrane-distal lobes, providing guidance for the stabilization of the prefusion conformation of RSV F. Based on a comparison of the pre- and post-fusion RSV F structures, there are two regions that undergo large conformational changes, located at the N- and C-termini of the $F_1$ subunit. For example, as illustrated in FIG. 2, the positions 137-216 and 461-513 of the $F_1$ polypeptide undergo structural rearrangement between the Pre- and Post-F protein conformations, whereas positions 271-460 of the $F_1$ polypeptide remain relatively unchanged. This example illustrates several strategies of stabilizing the RSV F protein in its prefusion conformation.

To stabilize the N-terminal region of $F_1$, which is a component of antigenic site Ø and is involved in binding to antibody D25, various strategies have been designed, including introduction of intra-protomer disulfide bonds, inter-protomer disulfide bonds, cavity filling amino acid substitutions, repacking substitutions, introduction of N-linked glycosylation sites, and combinations thereof.

Intra-Protomer Disulfide Bonds

Introduction of two cysteine residues that are within a sufficiently close distance to form an intra-protomer disulfide bond in the prefusion, but not postfusion, conformation can lock the F protein in the prefusion conformation. An intra-molecular disulfide bond can be formed within a single $F_2/F_1$ protomer within the trimer, and thus would not cross-link the three protomers together. Specifically, a disulfide bond formed between a region that changes conformation and a region that does not change conformation in the pre- and post-fusion structures should lock the protein in the prefusion conformation. One example is that of the S155C/S290C mutant, where Ser155 is located in a region that changes conformation, whereas Ser290 is in a region that does not change conformation. Additionally, formation of a disulfide bond between two regions that both change conformation, such as two residues located within $F_1$ positions 137-216, or two residues located within $F_1$ positions 461-513, or one residue within $F_1$ positions 137-216 and the second within $F_1$ positions 461-513, may also be sufficient to lock the protein in the prefusion conformation.

Using the methods described above, several pairs of residues of the RSV F protein were determined to be in close enough proximity in the prefusion conformation, but not the postfusion conformation, to form an intra-protomer disulfide bond if cysteines were introduces at the corresponding residue pair positions. These residue pairs, as well as the corresponding amino acid substitutions to SEQ ID NO: 1 needed to introduce cysteine residues at these positions, are indicated in Table 10. Table 10 also lists a SEQ ID NO containing the indicated substitutions, and corresponding to a precursor $F_0$ construct including a signal peptide, $F_2$ polypeptide (positions 26-109), pep27 polypeptide (positions 110-136), $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 10

Exemplary Cross-Linked Cysteine Pairs for Intra-Protomer Disulfide Bond Stabilization

| F protein Residue Pair(s) for Cysteine Substitution | A.A. substitutions corresponding to SEQ ID NO: 1 | SEQ ID NO |
|---|---|---|
| $F_1$ Substitutions | | |
| 155 and 290 | S155C and S290C | 185 |
| 151 and 288 | G151C and I288C | 189 |
| 137 and 337 | F137C and T337C | 213 |
| 397 and 487 | T397C and E487C | 247 |
| 138 and 353 | L138C and P353C | 257 |
| 341 and 352 | W341C and F352C | 267 |
| 403 and 420 | S403C and T420C | 268 |
| 319 and 413 | S319C and I413C | 269 |
| 401 and 417 | D401C and Y417C | 270 |
| 381 and 388 | L381C and N388C | 271 |
| 320 and 415 | P320C and S415C | 272 |
| 319 and 415 | S319C and S415C | 273 |
| 331 and 401 | N331C and D401C | 274 |
| 320 and 335 | P320C and T335C | 275 |
| 406 and 413 | V406C and I413C | 277 |
| 381 and 391 | L381C and Y391C | 278 |
| 357 and 371 | T357C and N371C | 279 |
| 403 and 417 | S403C and Y417C | 280 |
| 321 and 334 | L321C and L334C | 281 |
| 338 and 394 | D338C and K394C | 282 |
| 288 and 300 | I288C and V300C | 284 |
| $F_2$ and $F_1$ Substitutions | | |
| 60 and 194 | E60C and D194C | 190 |
| 33 and 469 | Y33C and V469C | 211 |
| 54 and 154 | T54C and V154C | 212 |
| 59 and 192 | I59C and V192C | 246 |
| 46 and 311 | S46C and T311C | 276 |
| 48 and 308 | L48C and V308C | 283 |
| 30 and 410 | E30C and L410C | 285 |

Intermolecular Disulfide Bonds

Introduction of two cysteine residues that are within a sufficiently close distance to form an inter-protomer disulfide bond in the prefusion, but not postfusion, conformation can lock the F protein in the prefusion conformation. An inter-protomer disulfide bond would be formed between adjacent protomers within the trimer, and thus would cross-link the three protomers together. Specifically, a disulfide bond formed between a region that changes conformation and a region that does not change conformation in the pre- and post-fusion structures should lock the protein in the prefusion conformation. One example is that of the A153C/K461C mutant, where Ala153 is located in a region that changes conformation, whereas Lys461 is in a region that does not change conformation. Additionally, formation of a disulfide bond between two regions that both change conformation, such as two residues located within $F_1$ positions 137-216, or two residues located within $F_1$ positions 461-513, or one residue within $F_1$ positions 137-216 and the second within $F_1$ positions 461-513, may also be sufficient to lock the protein in the prefusion conformation.

Using the methods described above, several pairs of residues of the RSV F protein were determined to be in close enough proximity in the prefusion conformation, but not the post-fusion conformation, to form an inter-protomer disulfide bond if cysteines were introduced at the corresponding residue pair positions. These residue pairs, as well as the corresponding amino acid substitutions needed to introduce cysteine residues at these positions, are indicated in Table 11. Table 11 also lists a SEQ ID NO containing the indicated substitutions, and corresponding to a precursor $F_0$ construct also including a signal peptide, $F_2$ polypeptide (positions 26-109), pep27 polypeptide (positions 110-136), $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 11

Exemplary Cross-Linked Cysteine Pairs for Inter-Protomer Disulfide Bond Stabilization

| F protein Residue pair(s) | A.A. substitutions corresponding to SEQ ID NO: 1 | SEQ ID NO |
|---|---|---|
| $F_1$ Substitutions | | |
| 400 and 489 | T400C and D489C | 201 |
| 144 and 406 | V144C and V406C | 202 |
| 153 and 461 | A153C and K461C | 205 |
| 149 and 458 | A149C and Y458C | 207 |
| 143 and 404 | G143C and S404S | 209 |
| 346 and 454 | S346C and N454C | 244 |
| 399 and 494 | K399C and Q494C | 245 |
| 146 and 407 | S146C and I407C | 264 |
| 374 and 454 | T374C and N454C | 265 |
| 369 and 455 | T369C and T455C | 266 |
| 402 and 141 | V402C and L141C | 302 |
| $F_2$ and $F_1$ Substitutions | | |
| 74 and 218 | A74C and E218C | 243 |

Additionally, multiple stabilizing mutations described herein can be combined to generate a PreF antigen containing more than one stabilizing mutation. Examples of such constructs containing a first and second residue pair that form an intra- or an inter-protomer disulfide bond are provided in Table 12. Table 12 also lists a SEQ ID NO containing the indicated substitutions, and corresponding to a precursor F0 construct also including a signal peptide, $F_2$ polypeptide (positions 26-109), pep27 polypeptide (positions 110-136), $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 12

Exemplary Cross-Linked Cysteine Pairs for Combinations of Intra-and Inter-Protomer Disulfide Bond Stabilization.

| F protein Residue pair(s) | Substitutions corresponding to SEQ ID NO: 1 | SEQ ID NO |
|---|---|---|
| 155 and 290 (Intra); and 402 and 141 (Inter) | S155C and S290C; and V402C and L141C | 303 |
| 155 and 290(Intra); and 74 and 218 | S155C and S290C; and A74C and E218C | 263 |

Further, amino acids can be inserted (or deleted) from the F protein sequence to adjust the alignment of residues in the F protein structure, such that particular residue pairs are within a sufficiently close distance to form an intra- or inter-protomer disulfide bond in the prefusion, but not postfusion, conformation, which, as discussed above, will stabilize the F protein in the prefusion conformation. Examples of such modification are provided in Table 13. Table 13 also lists a SEQ ID NO containing the indicated substitutions, and corresponding to a precursor $F_0$ construct also including a signal peptide, $F_2$ polypeptide (positions 26-109), pep27 polypeptide (positions 110-136), F1 polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 13

Using amino acid insertions to orient F proteins to accept inter-intra-protomer disulfide bonds, or combinations thereof.

| F protein Residue pair(s) | Substitutions corresponding to SEQ ID NO: 1 | SEQ ID NO |
|---|---|---|
| 155 and 290 (Intra); and 146 and 460 (Inter); G insertion between position 460/461 | S155C and S290C; and S146C and N460C; G insertion between position 460/461 | 258 |
| 155 and 290 (Intra); and 345 and 454(Inter); C insertion between positions 453/454 | S155C and S290C; and N345C and N454G; C insertion between positions 453/454 | 259 |
| 155 and 290 (Intra); and 374 and 454(Inter); C insertion between positions 453/454 | S155C and S290C; and T374C and N454G; C insertion between positions 453/454 | 260 |
| 155 and 290 (Intra); and 239 and 279(Inter); C insertion between positions 238/239 | S155C and S290C; and S238G and Q279C; C insertion between positions 238/239 | 261 |
| 155 and 290 (Intra); and 493 paired with C insertion between positions 329/330 | S155C and S290C; and S493C paired with a C insertion between positions 329/330 | 262 |
| 183 and 428 (Inter), G insertion between positions 182/183 | N183C and N428C; G insertion between positions 182/183 | 296 |
| 183 and 428 (Inter), C insertion between positions 427/428 | N183C and N427G; C insertion between positions 427/428 | 297 |
| 155 and 290 (Intra); and 183 and 428(Inter); G insertion between positions 182/183 | S155C and S290C; and N183C and N428C; G insertion between positions 182/183 | 298 |
| 155 and 290 (Intra); and 183 and 428(Inter); C insertion between positions 427/428 | S155C and S290C; and N183C and N427G; C insertion between positions 427/428 | 299 |
| 145 and 460 (Inter), AA insertion between positions 146/147 | S145C and 460C; AA insertion between positions 146/147 | 338 |
| 183 and 423 (Inter), AAA insertion between positions 182/183 | N183C and K423C; AAA insertion between positions 182/183 | 339 |
| 330 and 430 (Inter); CAA insertion between positions 329/330 | A329C and S430C; and a CAA insertion between positions 329/330 | 340 |

Cavity-Filling Substitutions

Comparison of the crystal structure of the RSV F protein in complex with D25 Fab (i.e., in a prefusion conformation) compared to the structure of the postfusion RSV F protein (disclosed, e.g., in McLellan et al., *J. Virol.*, 85, 7788, 2011; structural coordinates of the RSV F protein in its postfusion conformation are deposited in the Protein Data Bank (PDB) as PDB Accession No. 3RRR) identifies several internal cavities or pockets in the prefusion conformation that must collapse for F to transition to the postfusion conformation. These cavities are listed in Table 14. Accordingly, filling these internal cavities stabilizes F in the prefusion state, by preventing transition to the postfusion conformation. Cavities are filled by substituting amino acids with large side chains for those with small sidechains. The cavities can be intra-protomer cavities, or inter-protomer cavities. One example of a RSV F cavity-filling modification to stabilize the RSV protein in its prefusion conformation is the S190F/V207L mutant.

Using this strategy, several cavity filling modifications were identified to stabilize the RSV F protein in its prefusion conformation. These modifications, are indicated in Table 14. Table 14 also lists a SEQ ID NO containing the indicated substitutions, and corresponding to a precursor $F_0$ construct including a signal peptide, $F_2$ polypeptide (positions 26-109), pep27 polypeptide (positions 110-136), F1 polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 14

Exemplarity cavity-filling amino acid substitution

| Cavity | A.A. Substitutions | SEQ ID NO: |
|---|---|---|
| Ser190 and Val207 | 190F and 207L | 191 |
| Val207 | 207L and 220L | 193 |
| Ser190 and Val296 | 296F and 190F | 196 |
| Ala153 and Val207 | 220L and 153W | 197 |
| Val207 | 203W | 248 |
| Ser190 and Val207 | 83W and 260W | 192 |
| Val296 | 58W and 298L | 195 |
| Val90 | 87F and 90L | 194 |

The indicated cavities are referred to by a small residue abutting the cavity that can be mutated to a larger residue to fill the cavity. It will be understood that other residues (besides the one the cavity is named after) could also be mutated to fill the same cavity.

Repacking Substitutions

Additionally, the prefusion conformation of the RSV F protein may be stabilized by increasing the interactions of neighboring residues, such as by enhancing hydrophobic interactions or hydrogen-bond formation. Further, the prefusion conformation of the RSV F protein may be stabilized by reducing unfavorable or repulsive interactions of neighboring residues that lead to metastability of the prefusion conformation. This can be accomplished by eliminating clusters of similarly charged residues. Examples of such modifications are indicated in Table 15. Table 15 also lists a SEQ ID NO containing the indicated substitutions, and corresponding to a precursor $F_0$ construct including a signal peptide, $F_2$ polypeptide (positions 26-109), pep27 polypeptide (positions 110-136), $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 15

Repacking Amino Acid Substitutions

| Substitutions | SEQ ID NO |
|---|---|
| I64L, I79V, Y86W, L193V, L195F, Y198F, I199F, L203F, V207L, I214L | 227 |
| I64L, I79L, Y86W, L193V, L195F, Y198F, I199F, L203F, I214L | 228 |

TABLE 15-continued

Repacking Amino Acid Substitutions

| Substitutions | SEQ ID NO |
|---|---|
| I64W, I79V, Y86W, L193V, L195F, Y198F, I199F, L203F, V207L, I214L | 229 |
| I79V, Y86F, L193V, L195F, Y198F, I199F, L203F, V207L, I214L | 230 |
| I64V, I79V, Y86W, L193V, L195F, Y198F, I199Y, L203F, V207L, I214L | 231 |
| I64F, I79V, Y86W, L193V, L195F, Y198F, I199F, L203F, V207L, I214L | 232 |
| I64L, I79V, Y86W, L193V, L195F, I199F, L203F, V207L, I214L | 233 |
| V56I, T58I, V164I, L171I, V179L, L181F, V187I, I291V, V296I, A298I | 234 |
| V56I, T58I, V164I, V179L, T189F, I291V, V296I, A298I | 235 |
| V56L, T58I, L158W, V164L, I167V, L171I, V179L, L181F, V187I, I291V, V296L | 236 |
| V56L, T58I, L158Y, V164L, I167V, V187I, T189F, I291V, V296L | 237 |
| V56I, T58W, V164I, I167F, L171I, V179L, L181V, V187I, I291V, V296I | 238 |
| V56I, T58I, I64L, I79V, Y86W, V164I, V179L, T189F, L193V, L195F, Y198F, I199F, L203F, V207L, I214L, I291V, V296I, A298I | 239 |
| V56I, T58I, I79V, Y86F, V164I, V179L, T189F, L193V, L195F, Y198F, I199F, L203F, V207L, I214L, I291V, V296I, A298I | 240 |
| V56I, T58W, I64L, I79V, Y86W, V164I, I167F, L171I, V179L, L181V, V187I, L193V, L195F, Y198F, I199F, L203F, V207L, I214L, I291V, V296I | 241 |
| V56I, T58W, I79V, Y86F, V164I, I167F, L171I, V179L, L181V, V187I, L193V, L195F, Y198F, I199F, L203F, V207L, I214L, I291V, V296I | 242 |
| D486N, E487Q, D489N, and S491A | 249 |
| D486Q, E487Q, and D489H | 250 |
| T400V, D486L, E487L, and D489L | 251 |
| T400V, D486L, E487L, and D489I | 252 |
| T400V, S485I, D486L, E487L, D489L, Q494L, and K498L | 253 |
| T400V, S485I, D486I, E487L, D489I, Q494L, and K498L | 254 |
| K399I, T400V, S485I, D486L, E487L, D489L, Q494L, E497L, and K498L | 255 |
| K399I, T400V, S485I, D486I, E487L, D489I, Q494L, E497L, and K498L | 256 |
| L375W, Y391F, and K394M | 286 |
| L375W, Y391F, and K394W | 287 |
| L375W, Y391F, K394M, D486N, E487Q, D489N, and S491A | 288 |
| L375W, Y391F, K394M, D486H, E487Q, and D489H | 289 |
| L375W, Y391F, K394W, D486N, E487Q, D489N, and S491A | 290 |
| L375W, Y391F, K394W, D486H, E487Q, and D489H | 291 |
| L375W, Y391F, K394M, T400V, D486L, E487L, D489L, Q494L, and K498M | 292 |
| L375W, Y391F, K394M, T400V, D486I, E487L, D489I, Q494L, and K498M | 293 |
| L375W, Y391F, K394W, T400V, D486L, E487L, D489L, Q494L, and K498M | 294 |
| L375W, Y391F, K394W, T400V, D486I, E487L, D489I, Q494L, and K498M | 295 |
| F137W and R339M | 326 |
| F137W and F140W | 327 |
| F137W, F140W, and F488W | 328 |
| D486N, E487Q, D489N, S491A, and F488W | 329 |
| D486H, E487Q, D489H, and F488W | 330 |
| T400V, D486L, E487L, D489L, and F488W | 331 |
| T400V, D486L, E487L, D489I, and F488W | 332 |
| D486N, E487Q, D489N, S491A, F137W, and F140W | 333 |
| D486H, E487Q, D489H, F137W, and F140W | 334 |
| T400V, D486L, E487L, D489L, F137W, and F140W | 335 |
| L375W, Y391F, K394M, F137W, and F140W or | 336 |
| L375W, Y391F, K394M, F137W, F140W, and R339M | 337 |

Glycosylation Mutations

Additionally, introduction of N-linked glycosylation sites that would be solvent-accessible in the prefusion RSV F conformation but solvent-inaccessible in the postfusion RSV F conformation may stabilize RSV F in the prefusion state by preventing adoption of the postfusion state. To create an N-linked glycosylation site, the sequence Asn-X-Ser/Thr (where X is any amino acid except Pro) may be introduced. This can be accomplished by substitution of a Ser/Thr amino acid two residues C-terminal to a native Asn residue, or by substitution of an Asn amino acid two residues N-terminal to a native Ser/Thr residue, or by substitution of both an Asn and Ser/Thr residue separated by one non-proline amino acid.

Using this strategy, several locations for N-linked glycosylation sites that would be solvent-accessible in the prefusion RSV F conformation but solvent-inaccessible in the postfusion RSV F conformation were identified. These modifications are indicated in Table 16. Table 16 also lists the SEQ ID NO containing the indicated substitutions, and corresponding to a precursor $F_0$ construct including a signal peptide, $F_2$ polypeptide (positions 26-109), pep27 polypeptide (positions 110-136), $F_1$ polypeptide (positions 137-513), a trimerization domain (a Foldon domain) and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))).

TABLE 16

Exemplary N-linked glycosylation

| N-linked glycosylation position | Exemplary substitutions | Exemplary SEQ ID NO |
|---|---|---|
| 506 | I506N and K508T | 198 |
| 175 | A177S | 199 |
| 178 | V178N | 200 |
| 276 | V278T | 203 |
| 476 | Y478T | 204 |
| 185 | V185N and V187T | 214 |
| 160 | L160N and G162S | 215 |
| 503 | L503N and a F505S | 216 |
| 157 | V157N | 217 |

Example 3

Stabilizing the Membrane Proximal Lobe of PreF Antigens

As discussed above, the crystal structure of the RSV F protein in complex with D25 Fab (i.e., in a prefusion conformation) compared to the structure of the postfusion RSV F protein ((disclosed, e.g., in McLellan et al., *J. Virol.*, 85, 7788, 2011, with coordinates deposited as PDB Accession No. 3RRR)) shows dramatic structural rearrangements between pre- and post-fusion conformations in the membrane-distal lobe. Based on a comparison of the pre- and post-fusion RSV F structures, there are two regions that undergo large conformational changes, located at the N- and C-termini of the F1 subunit. For example, as illustrated in FIG. 2, the positions 137-216 and 461-513 of the $F_1$ polypeptide undergo structural rearrangement between the Pre- and Post-F protein conformations, whereas positions 271-460 of the $F_1$ polypeptide remain relatively unchanged. This example illustrates several strategies of stabilizing the C-terminal region of $F_1$, which includes the membrane proximal lobe of the RSV F protein. Various strategies have been identified, including introduction of a trimerization domain (as discussed above), introduction of cysteine pairs that can form a disulfide bond that stabilizes the C-terminal region of F1, and introduction of a transmembrane domain (e.g., for applications including a membrane-bound PreF antigen).

Disulfide Bonds

One strategy for stabilizing the membrane proximal lobe of the F protein is to introduce one or more cysteine substitutions that introduce a disulfide bond that that stabilizes the C-terminal portion of $F_1$ (for example, for an application including a soluble PreF antigen). Such a strategy can be combined with any of the stabilization modifications provided herein, for example, those described in Example 2, such as a $F_1$ protein with a S155C/S290C cysteine substitution. One strategy includes introduction of two cysteine residues that are within a sufficiently close distance to form an inter-protomer disulfide bond that links the C-terminal region of the $F_1$ protein in the prefusion conformation. An inter-protomer disulfide bond would be formed between adjacent protomers within the trimer, and thus would cross-link the three protomers together. Using the methods described above, several pairs of residues of the RSV F protein were determined to be in close enough proximity in the prefusion conformation, to form an inter-protomer disulfide bond if cysteines were introduces at the corresponding residue pair positions.

Examples of cysteine substitutions that can be introduced to generate a disulfide bond that stabilizes the membrane proximal lobe include cysteine substitutions at residue pairs:

(a) 486 and 487
(b) 486 and 487; with a P insertion between positions 486/487
(c) 512 and 513
(d) 493; C insertion between 329/330
(e) 493; C insertion between 329/330, and G insertion between 492/493

Further, the length of the $F_1$ polypeptide can be varied, depending on the position of the of the C-terminal cysteine pair. For example, the $F_1$ polypeptide can include positions 137-481, which eliminate the α10 helix from the $F_1$ polypeptide.

Examples of constructs containing modifications including cysteines at these residue pairs, as well as additional description are listed in Table 17. Table 17 also lists a SEQ ID NO containing the indicated substitutions, and corresponding to a precursor $F_0$ construct also including a signal peptide, $F_2$ polypeptide (positions 26-109), pep27 polypeptide (positions 110-136), $F_1$ polypeptide (with varying positions).

TABLE 17

Disulfide bonds to stabilize the membrane proximal lobe of F protein.

| Substitutions/insertion | Description | $F_1$ positions | SEQ ID NO |
|---|---|---|---|
| D486C/E487C; S155C/S290C | The D486C and E487C mutant allows inter-protomer disulfide bond formation while the S155C/S290C mutations stabilize the prefusion format, this construct does not have a Foldon or alpha-10 helix. | 137-481 | 304 |
| S155C/S290C; D486C/E487C; P insertion between positions 486/487 | The D486C and E487C mutant should allow inter-protomer disulfide bond formation while the S155C/S290C mutations stabilize the prefusion format, this construct does not have a Foldon or alpha-10 helix. | 137-481 | 305 |
| N183C/N428C; D486C/E487C; G insertion between 182/183 | The D486C and E487C mutant should allow inter-protomer disulfide bond formation while the 183C and 428C mutations stabilize the prefusion format. This construct removes the Foldon sequence and the alpha-10 sequence. | | 306 |

TABLE 17-continued

Disulfide bonds to stabilize the membrane proximal lobe of F protein.

| Substitutions/insertion | Description | $F_1$ positions | SEQ ID NO |
|---|---|---|---|
| | removes the Foldon sequence and the alpha-10 sequence. | | |
| N183C/K427G; C insertion between 247/428; D486C/E487C P; insertion between positions 486/487 | The D486C and E487C mutant should allow inter-protomer disulfide bond formation while the 183C and 428C mutations stabilize the prefusion format. This construct removes the Foldon sequence and the alpha-10 sequence. | 137-481 | 307 |
| V402C/L141C; L512C/L513C | The 141C and 402C stabilize the prefusion form by locking down the fusion peptide. While the 512C and 513C create an inter-protomer disulfide bond; this construct does not have a foldon domain. | 1-513 | 308 |
| S155C/S290C; V402C/L141C L512C/L513C | The 141C and 402C stabilize the prefusion form by locking down the fusion peptide in conjunction with the S155C/S290C. While the 512C and 513C create an inter-protomer disulfide bond, the foldon sequence is removed. | 1-513 | 309 |
| S155C/S290C; S493C; C insertion between 329/330 | Removal of the "foldon" and the facilitation of intermolecular disulfide bond stabilization while the S155C/S290C mutations stabilize the prefusion format | 137-491 | 310 |
| S155C/S290C; S493C; C insertion between 329/330; G insertion between 492/493 | Removal of the "foldon" and the facilitation of intermolecular disulfide bond stabilization while the S155C/S290C mutations stabilize the prefusion format | 137-491 | 311 |

Transmembrane Domains

Another strategy for stabilizing the membrane proximal lobe of the F protein is to include a transmembrane domain on the $F_1$ protein, for example, for an application including a membrane anchored PreF antigen. For example, the presence of the transmembrane sequences is useful for expression as a transmembrane protein for membrane vesicle preparation. The transmembrane domain can be linked to a $F_1$ protein containing any of the stabilizing mutations provided herein, for example, those described in Example 2, such as a $F_1$ protein with a S155C/S290C cysteine substitution. Additionally, the transmembrane domain can be further linked to a RSV $F_1$ cytosolic tail. Examples of precursor $F_0$ constructs including a signal peptide, $F_2$ polypeptide (positions 26-109), pep27 polypeptide (positions 110-136), $F_1$ polypeptide (positions 137-513), a RSV transmembrane domain are provided as SEQ ID NOs: 323 (without a cytosolic domain) and 324 (with a cytosolic domain).

Example 4

Single Chain PreF Antigens

This example illustrates recombinant RSV F proteins that lack the native furin cleavage sites, such that the F protein protomer is formed as a single polypeptide chain, instead of a F2/$F_1$ heterodimer.

Table 18 lists several single chain PreF antigens that include deletion of F positions 98-149, which removes the two furin cleavage sites, the pep27 polypeptide, and the fusion peptide. The remaining portions of the $F_1$ and $F_2$ polypeptides are joined by a linker. Additionally, several strategies can be employed to stabilize the single chain constructs in a prefusion conformation, including use of the strategies described in examples 2 and 3, above. Table 18 also lists a SEQ ID NO containing the indicated substitutions, and corresponding to a precursor $F_0$ construct also including a signal peptide, $F_2$ polypeptide (positions 26-109), pep27 polypeptide (positions 110-136), $F_1$ polypeptide (with varying positions).

serine 290. In view of these findings, a recombinant RSV F protein was constructed with S155C and S290C substitutions. It was expected that the cysteine residues in this 155/290 construct would form a disulfide bond that would lock the recombinant RSV F protein in the prefusion conformation, but that incorporation of cysteines at positions 154 or 156 (instead of position 155) would fail to produce a stabilizing disulfide bond.

A nucleic acid molecule encoding a native RSV $F_0$ polypeptide was mutated using standard molecular biology

TABLE 18

Single chain PreF antigens

| Substitutions | Discussion | $F2/F_1$ Linker | C-term Stabilization | SEQ ID NO |
|---|---|---|---|---|
| S155C/S290C L373R Δ98-149 | (A) The rationale for this construct is to create a single chain RSV fusion molecule, remove the nucleus localization signal (L373R), and the fusion peptide (, while the S155C/S290C mutations stabilize the prefusion format | GSGNVGLGG (SEQ ID NO: 356) | Foldon | 313 |
| S155C/S290C L373R Δ98-149 | Same as (A) | GSGNWGLGG (SEQ ID NO: 357) | Foldon | 314 |
| S155C/S290C L373R Δ98-149 | Same as (A) | GSGNIGLGG (SEQ ID NO: 358) | Foldon | 315 |
| S155C/S290C L373R Δ98-149 | Same as (A) | GSGGNGIGLGG (SEQ ID NO: 359) | Foldon | 316 |
| S155C/S290C L373R Δ98-149 | Same as (A) | GSGGSGGSGG (SEQ ID NO: 360) | Foldon | 317 |
| S155C/S290C L373R Δ98-149 | Same as (A) | GSGNVLGG (SEQ ID NO: 361) | Foldon | 318 |
| S155C/S290C L373R Δ98-149 | (B) The rationale for this construct is to create a single chain RSV fusion molecule, remove the nucleus localization signal, and the fusion peptide and also the alpha 10 helix and Foldon, while the S155C/S290C mutations stabilize the prefusion format | GSGNVGLGG (SEQ ID NO: 362) | D486C/E487C; P insertion between positions 486/487 | 319 |
| S155C/S290C/ L373R Δ98-149 | Same as (B) | GSGNVGLGG (SEQ ID NO: 363) | L512C/L513C | 320 |
| S155C/S290CL 373R Δ98-149 | Same as (A) | GSGNIGLGG (SEQ ID NO: 364) | TM | 322 |

Example 5

RSV F Protein Stabilized with a Disulfide Bond and a Trimerization Domain

Figure 10:
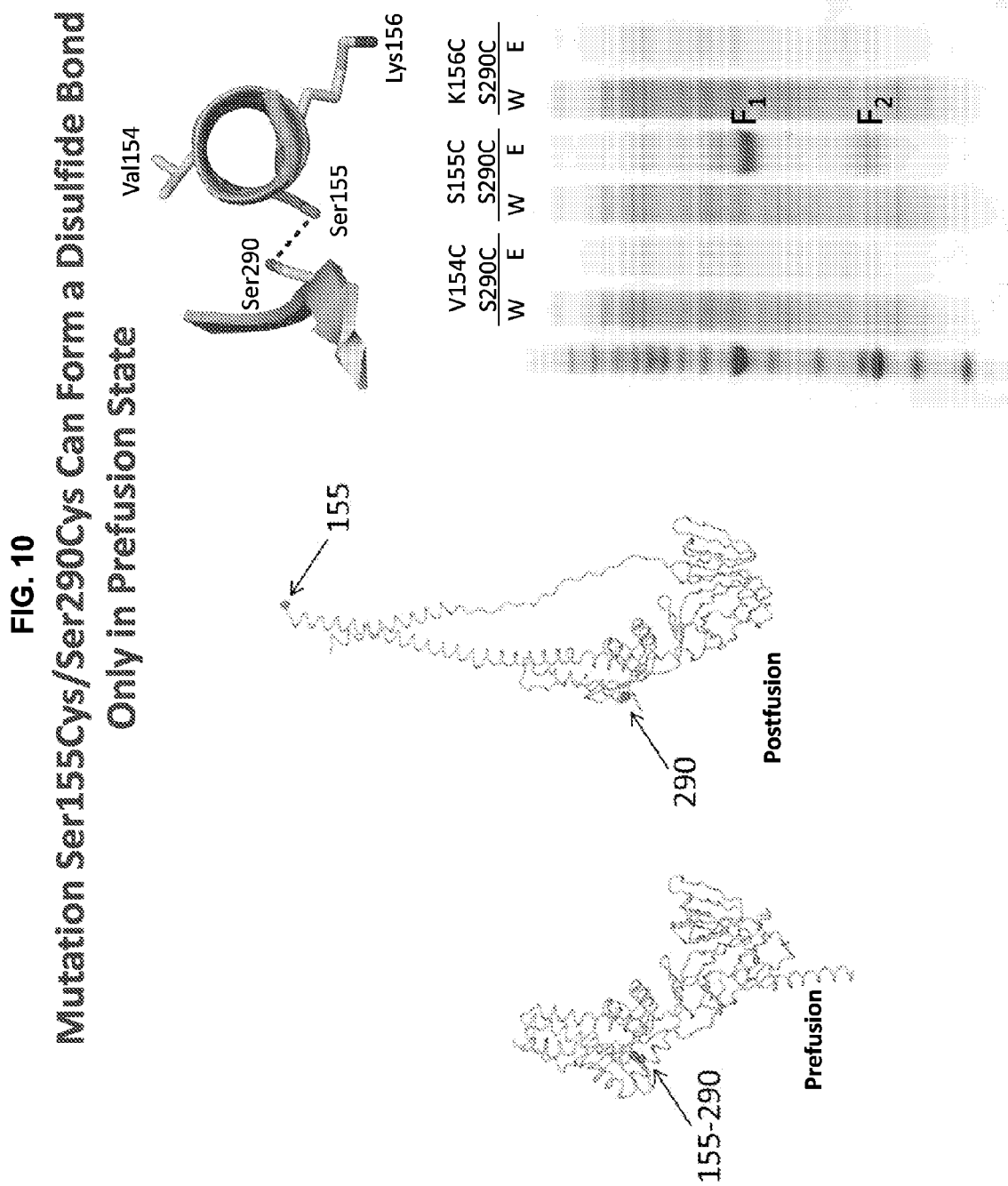
FIG. 10 shows an image of a polyacrylamide gel illustrating expression of the recombinant RSV F protein construct with S155C and S290C amino acid substitutions and a Foldon domain linked to the C-terminus of $F_1$, and a set of diagrams illustrating that the disulfide bond between S155C and S290C can only form in the prefusion conformation of RSV F protein.

This example illustrates production of a RSV F protein stabilized with a disulfide bond and a trimerization domain. As illustrated in FIG. 10, the serine residues at positions 155 and 290 (indicated by arrows and red highlighting in the ribbon diagrams) are adjacent to each other in the prefusion conformation of RSV F protein, but not in the post fusion conformation of the RSV F protein. Further, the side chains of these residues are oriented towards one another. However, the side chains of the residues adjacent to serine 155, valine 154 and lysine 156, are oriented away from the side chain of techniques to encode the RSV F protein called RSVF(+) FdTHS S155C, S290C, and set forth as SEQ ID NO: 185:

(SEQ ID NO: 185)
MELLILKANAITTILTAVTFCFASGQNITEEFYQSTCSAVSKGYLSALRT

GWYTSVITIELSNIKENKCNGTDAKVKLIKQELDKYKNAVTELQLLMQST

PATNNRARRELPRFMNYTLNNAKKTNVTLSKKRKRRFLGFLLGVGSAIAS

GVAVCKVLHLEGEVNKIKSALLSTNKAVVSLSNGVSVLTSKVLDLKNYID

KQLLPIVNKQSCSISNIETVIEFQQKNNRLLEITREFSVNAGVTTPVSTY

MLTNSELLSLINDMPITNDQKKLMSNNVQIVRQQSYSIMCIIKEEVLAYV

-continued
VQLPLYGVIDTPCWKLHTSPLCTTNTKEGSNICLTRTDRGWYCDNAGSVS

FFPQAETCKVQSNRVFCDTMNSLTLPSEVNLCNVDIFNPKYDCKIMTSKT

DVSSSVITSLGAIVSCYGKTKCTASNKNRGIIKTFSNGCDYVSNKGVDTV

SVGNTLYYVNKQEGKSLYVKGEPIINFYDPLVEPSDEFDASISQVNEKIN

QSLAFIRKSDELLSAIGGYIPEAPRDWAYVRKDGEWVLLSTFLGGLVPRG

SHHHHHHSAWSHPQFEK.

RSVF(+)FdTHS S155C, S290C includes a signal peptide (residues 1-25), F$_2$ polypeptide (residues 26-109), Pep27 polypeptide (residues 110-136), F$_1$ polypeptide (residues 137-513), Foldon domain (residues 514-544), and a thrombin cleavage site (LVPRGS (positions 547-552 of SEQ ID NO: 185)) and purification tags (his-tag (HHHHHH (positions 553-558 of SEQ ID NO: 185)) and Strep Tag II (SAWSHPQFEK (positions 559-568 of SEQ ID NO: 185))). Control constructs were also generated with V154C or K156C substitutions instead of the S155C substitution.

When expressed in cells, RSVF(+)FdTHS S155C, S290C was processed and expressed as a stable and soluble RSV F protein; however, the control constructs with 154/290 or 156/290 substitutions failed to express (likely because they failed to fold in a soluble conformation) (see FIG. 10).

The RSVF(+)FdTHS S155C, S290C construct was purified and tested for antibody binding to the prefusion specific antibodies AM22 and D25, as well as 131-2a antibody (which binds antigenic site I, present on pre- and post-fusion RSV F conformations), motavizumab and palivizumab (which bind antigenic site II, present on pre- and post-fusion RSV F conformations), and 101F antibody (which binds antigenic site IV, present on pre- and post-fusion RSV F conformations). As shown in FIG. 11 (left graph), all of these antibodies specifically bound to the purified RSVF(+) FdTHS S155C, S290C construct, indicating that RSVF(+) FdTHS S155C, S290C maintains a prefusion conformation. The results further indicate that this construct maintains antigenic sites I, II and IV, common to both the pre- and post-fusion conformations of RSV F.

To demonstrate that purified RSVF(+)FdTHS S155C, S290C is in a trimeric conformation, this construct was passed over a size-exclusion chromatography column. As shown in FIG. 11 (right graphs) a preparation of purified RSVF(+)FdTHS S155C, S290C eluted in a single peak corresponding to the molecular weight of the trimeric F protein. In contrast, a preparation of a control construct lacking the S155C and S290C substitutions, which is not expected to be stabilized in the prefusion conformation, eluted in multiple peaks, indicating the presence of rosettes of triggered F protein and aggregates, indicating that this control construct is not stable in a homogeneous prefusion conformation.

Figure 12:
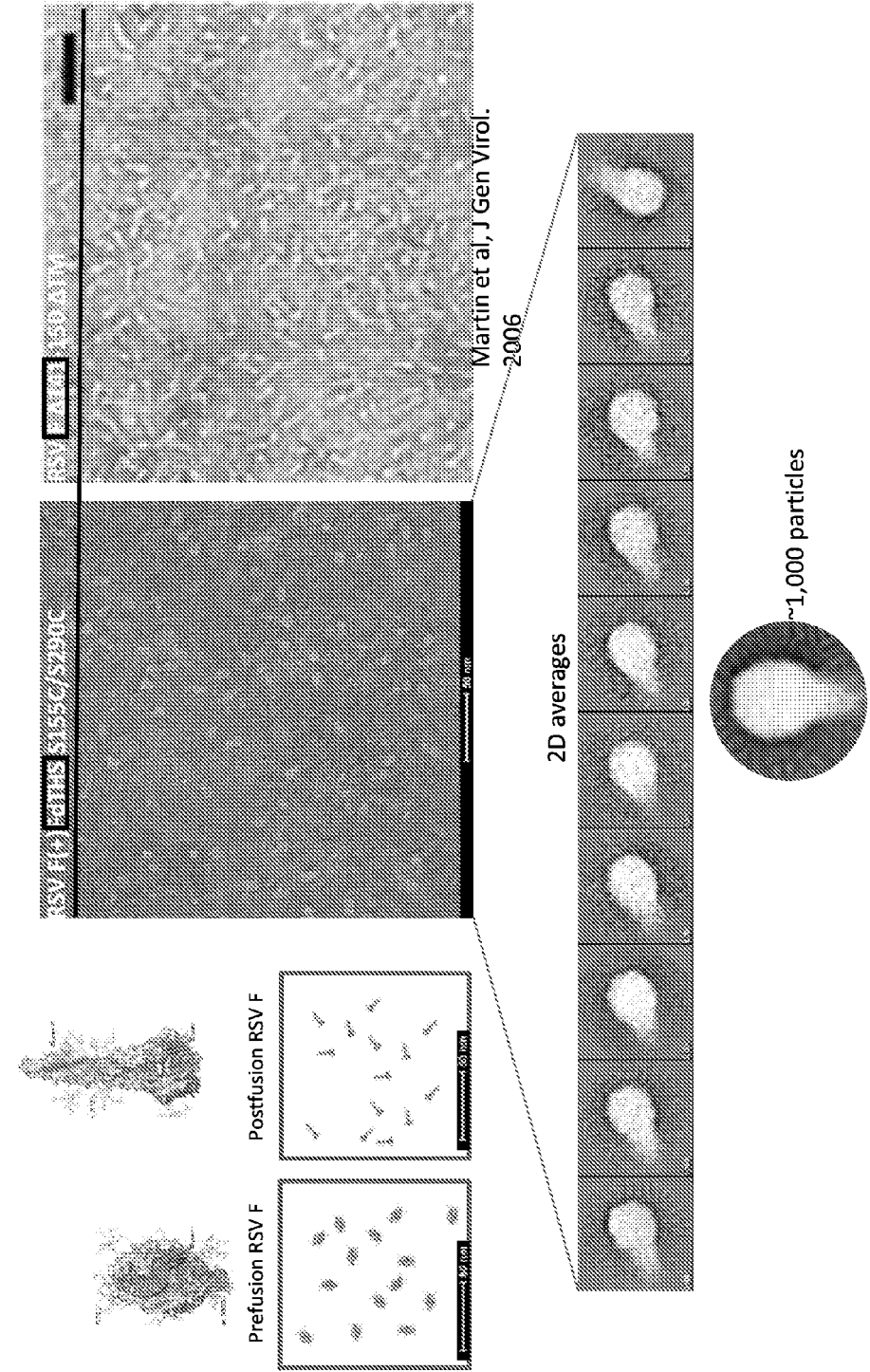
FIG. 12 shows negative-stain electron microscopy images of recombinant RSV F protein construct with S155C and S290C amino acid substitutions and a Foldon domain linked to the C-terminus of F1. The images below the large panel are 2D averages of individual particles. The results indicate that the S155C/S290C construct is stabilized in the prefusion conformation.

To further confirm that the RSVF(+)FdTHS S155C, S290C construct is stabilized in a prefusion conformation, electron microscopy studies were performed (FIG. 12) and demonstrate that RSVF(+)FdTHS S155C, S290C form homogeneous population of structures with a shape similar to that of the prefusion conformation of RSV F, and significantly different from that of the postfusion F protein (right image, from Martin et al., *J. Gen. Virol.*, 2006).

Crystallography studies were performed to demonstrate that purified RSVF(+)FdTHS S155C, S290C is homogeneous in solution. Formation of crystals in aqueous solution is a stringent test for the homogeneity of a protein in solution. FIG. 15 shows pictures of the crystals formed by purified RSVF(+)FdTHS S155C, S290C in aqueous buffer containing 0.2 M lithium sulfate, 1.64 M Na/K tartrate and 0.1 M CHES, at pH 9.5. The formation of RSVF(+)FdTHS S155C, S290C crystals in aqueous buffer demonstrates that this protein is substantially homogeneous in solution.

Example 6

Induction of a Neutralizing Immune Response Using a PreF Antigen

This example illustrates use of a PreF antigen to elicit a RSV neutralizing immune response in a subject.

Eight week old pathogen-free CB6F1/J mice (Jackson Labs) were divided into 5 groups of 10 each, and immunized with the following regimens:
1) live RSV A2 (RSV) at 5×10$^6$ pfu intranasally;
2) formalin-inactivated alum-precipitated RSV(FI-RSV) intramuscularly (IM);
3) stabilized prefusion RSV F (RSVF(+)FdTHS S155C, S290C; prefusion F) 20 µg in polyI:C 50 µg IM;
4) postfusion RSV F trimer ((postfusion RSV) 20 µg in polyI:C 50 µg IM; and Group 1 (live RSV) was infected once at time 0, and all other groups were immunized at 0 and 3 weeks. Serum was obtained at week 5, two weeks after the 2' IM injection or five weeks post RSV infection. Neutralizing activity was determined by the following method: Sera were distributed as four-fold dilutions from 1:10 to 1:40960, mixed with an equal volume of recombinant mKate-RSV expressing prototypic F genes from either strain A2 (subtype A) or 18537 (subtype B) and the Katushka fluorescent protein, and incubated at 37° C. for one hour. Next, 50 µl of each serum dilution/virus mixture was added to HEp-2 cells that had been seeded at a density of 1.5×10$^4$ in 30 µl MEM (minimal essential medium) in each well of 384-well black optical bottom plates, and incubated for 20-22 hours before spectrophotometric analysis at Ex 588 nm and Em 635 nm (SpectraMax Paradigm, Molecular Devices, Sunnyvale, Calif. 94089). The IC50 for each sample was calculated by curve fitting and non-linear regression using GraphPad Prism (GraphPad Software Inc., San Diego Calif.). P values were determined by Student's T-test. The above method for measuring RSV neutralization was performed substantially as described previously (see, e.g., Chen et al. J. Immunol. Methods., 362:180-184, 2010, incorporated by reference herein), except that the readout was by a fluorescent plate-reader instead of flow cytometry.

Figure 13:
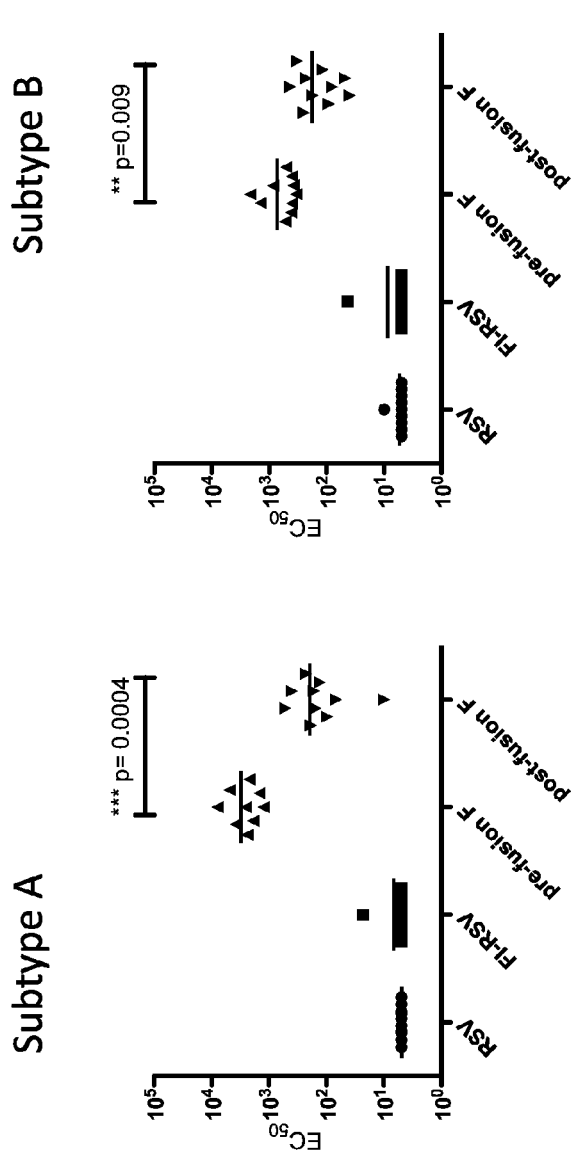
FIGS. 13-14 show a set of graphs illustrating the neutralizing antibody response of mice administered native RSV (RSV), formalin inactivated RSV (FI-RSV), the recombinant RSV F protein construct with S155C and S290C amino acid substitutions and a Foldon domain linked to the C-terminus of $F_1$ (prefusion F), or a RSV F protein construct stabilized in the postfusion conformation (postfusion RSV). The antibody response at 5 weeks (FIG. 13) and 7 weeks (FIG. 14) post-initial immunization is shown.
Figure 14:
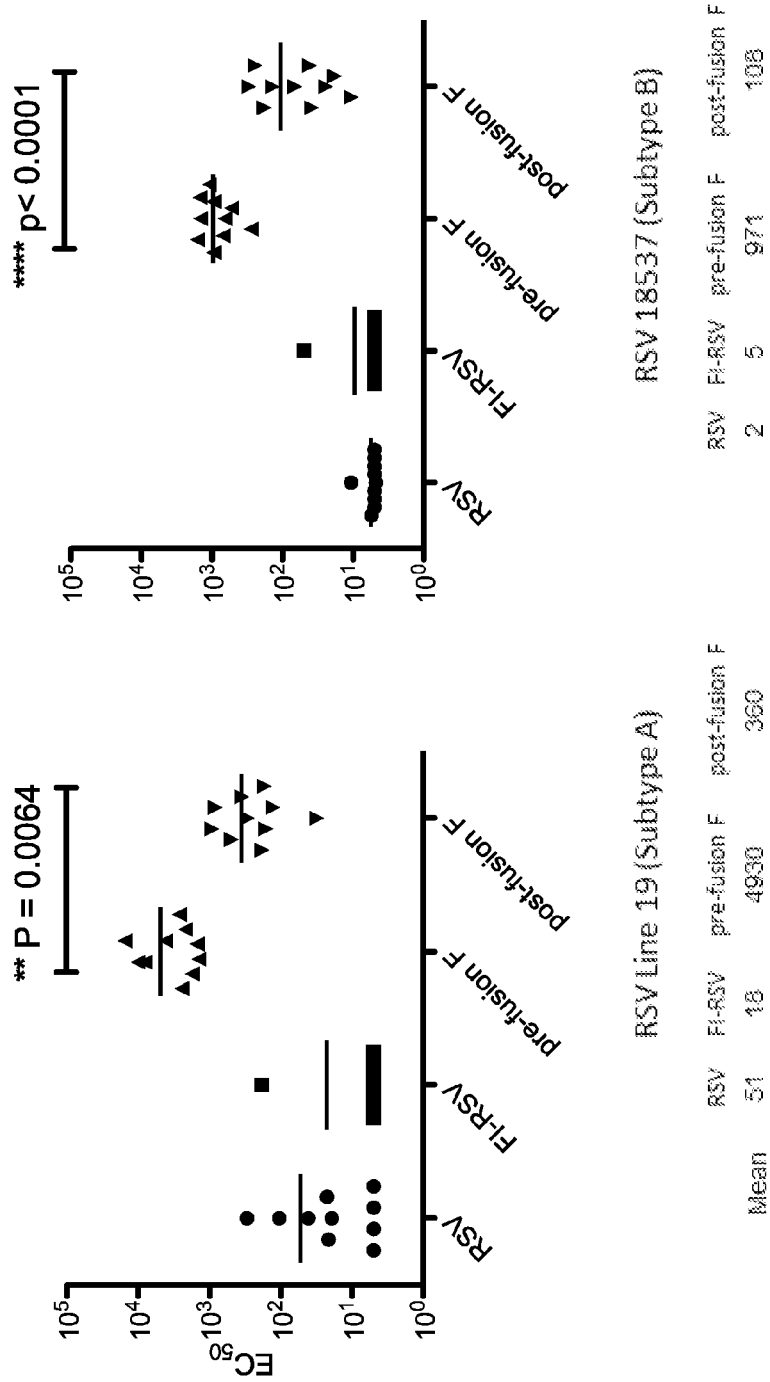
Figure 41:
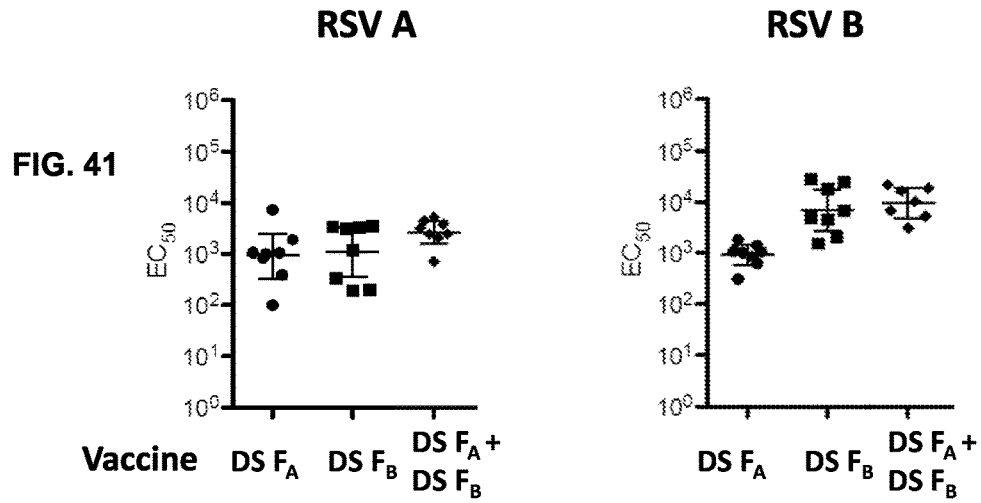
FIG. 41 shows the effect of using RSV subtype B constructs with the DS substitutions and that adjuvants including TLR4 agonists can work with the stabilized F protein. CB6F1/J mice were immunized with 10 µg of the DS S155C/S290C version of stabilized prefusion F formulated with 50 µl of Ribi (Ribi adjuvant system, Sigma). Mice were inoculated at 0 and 3 weeks with either the subtype A construct (SEQ ID NO: 185), the subtype B construct (SEQ ID NO: 1479), or both (10 µg of each). At the 5 week time point (2 weeks after the second injection), serum was obtained for neutralization assays. The two major findings from this experiment were that, 1) preF$_A$-DS and preF$_B$-DS induce equal levels of neutralizing activity against RSV subtype A, while preF$_B$-DS induced a higher level of neutralizing activity than preF$_B$-DS against RSV subtype B. This suggests that using the RSV subtype B constructs may have better cross-neutralizing potential than subtype A constructs or that hybrid versions of RSV F that include elements from both subtypes may be preferred. 2) The Ribi adjuvant is an oil-in-water emulsion containing monophosphoryl lipid A, which is a TLR4 agonist and representative of some of commercial adjuvants. These data show that in addition to polyI:C (a TLR3 agonist), adjuvants that include TLR4 agonists function with the stabilized prefusion F protein as a vaccine antigen.

Using this assay, generally antibody responses above ~100 EC$_{50}$ would be considered to be protective. As shown in FIGS. 13 and 14, mice administered an RSV F protein stabilized in a prefusion conformation (RSV F (RSVF(+) FdTHS S155C, S290C) produced a neutralizing immune response to RSV A ~15-fold greater than that produced by mice administered a RSV F protein in a postfusion conformation, and a response to RSV B ~5-fold greater than that produced by mice administered a RSV F protein in a postfusion conformation. FIG. 13 shows the results after 5 weeks post-initial immunization, and FIG. 14 shows results after 7 weeks post immunization. The mean elicited IC50 values are also shown in FIGS. 13 and 14. The difference in neutralization between RSV A and B subgroups is not surprising as the RSVF(+)FdTHS S155C, S290C construct is derived from a F protein from an RSV A subgroup. It is expected that immunization with a corresponding construct derived from a RSV B strain would generate neutralizing sera more specific for RSV B (see FIG. 41).

Figure 42:
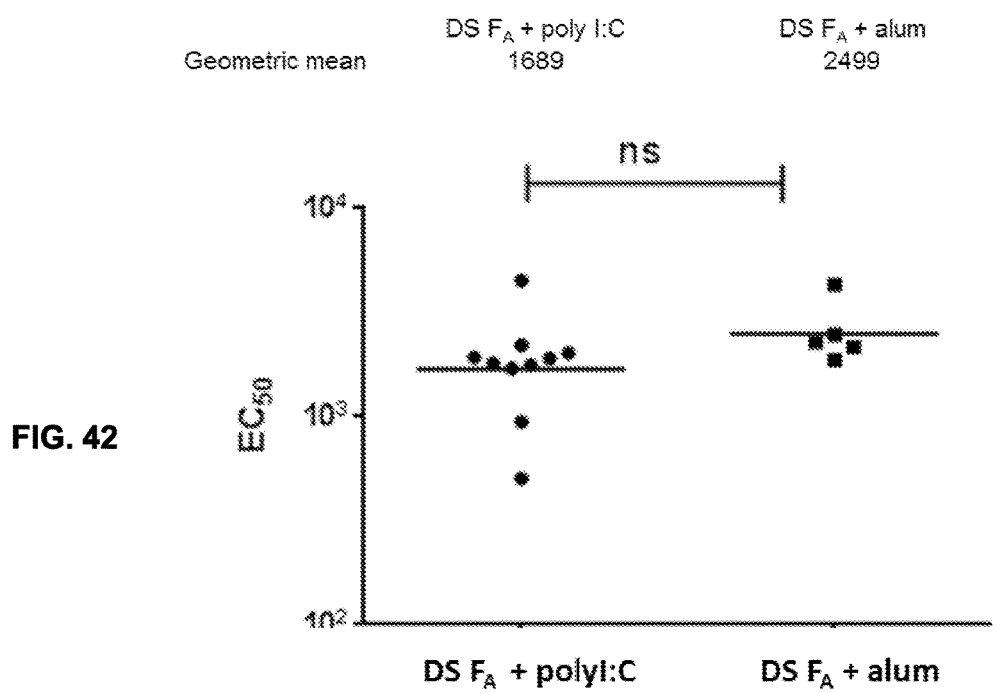
FIG. 42 shows that the stabilized prefusion F can be formulated in alum as well as polyI:C and retain immunogenicity conferred by antibody responses to antigenic site Ø.

Further, it was shown that the stabilized prefusion F can be formulated in alum as well as polyI:C and retain immunogenicity conferred by antibody responses to antigenic site Ø. BALB/c mice were immunized with 20 μg of the DS S155C/S290C version of stabilized prefusion F derived from subtype A and formulated with alum (aluminum hydroxide gel 10 mg/ml, Brenntag, Frederikssund, Denmark) or polyI:C. Mice were inoculated at 0 and 3 weeks, and at the 5 week time point (2 weeks after the second injection), serum was obtained for neutralization assays (see FIG. 42). The results show that immunization with a RSV F protein stabilized in a prefusion conformation produces a protective immune response to RSV.

Example 7

Treatment of Subjects with the Disclosed Antigens

This example describes methods that can be used to treat a subject that has or is at risk of having an RSV infection by administration of one or more of the disclosed PreF antigens, or a nucleic acid or a viral vector encoding, expressing or including a PreF antigen. In particular examples, the method includes screening a subject having, thought to have, or at risk of having (for example due to impaired immunity, physiological status, or exposure to RSV) an RSV infection. Subjects of an unknown infection status can be examined to determine if they have an infection, for example using serological tests, physical examination, enzyme-linked immunosorbent assay (ELISA), radiological screening or other diagnostic technique known to those of ordinary skill in the art. In some examples, a subject is selected that has an RSV infection or is at risk of acquiring an RSV infection. Subjects found to (or known to) have an RSV infection and thereby treatable by administration of the disclosed PreF antigens, or a nucleic acid or a viral vector encoding, expressing or including a PreF antigen are selected to receive the PreF antigens, or a nucleic acid or a viral vector encoding, expressing or including a PreF antigen. Subjects may also be selected who are at risk of developing an RSV infection for example, the elderly, the immunocompromised and the very young, such as infants.

Subjects selected for treatment can be administered a therapeutic amount of disclosed PreF antigens. An immunogenic composition including the PreF antigen can be administered at doses of 0.1 μg/kg body weight to about 1 mg/kg body weight per dose, such as 0.1 μg/kg body weight to about 1 mg/kg body weight, 0.1 μg/kg body weight to about 10 mg/kg body weight per dose, 1 mg/kg body weight-100 mg/kg body weight per dose, 100 μg/kg body weight-500 μg/kg body weight per dose, or 500 μg/kg body weight-1000 μg/kg body weight per dose or even greater. In some embodiments, about 5, 10, 20, 30, 40, 50, 60, 70, 80, 90, or about 100 μg of the PreF antigen is included in the immunogenic composition that is administered to the subject in a single dose. The immunogenic composition can be administered in several doses, for example continuously, daily, weekly, or monthly. The mode of administration can be any used in the art, such as nasal administration. The amount of agent administered to the subject can be determined by a clinician, and may depend on the particular subject treated. Specific exemplary amounts are provided herein (but the disclosure is not limited to such doses).

Example 8

RSV F Protein Stabilized with a Disulfide Bond, Cavity Filling Substitutions, and a Trimerization Domain This example illustrates production of a RSV F protein stabilized with a disulfide bond and a trimerization domain.

Figure 16:
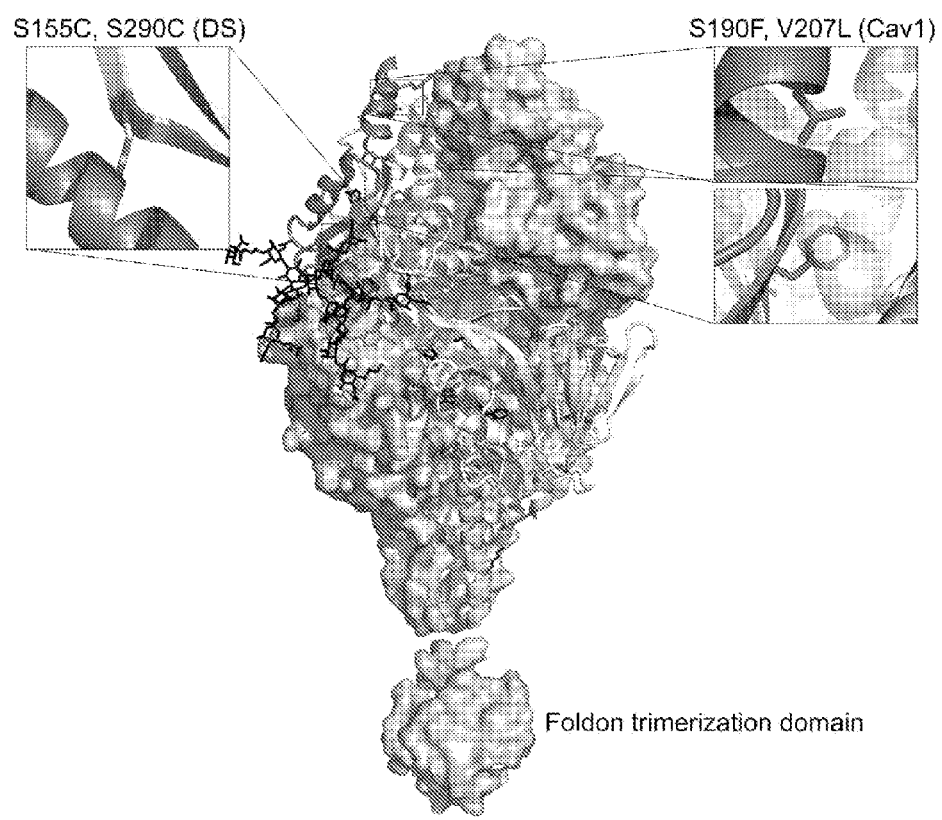
FIG. 16 shows the design of a RSV F protein based antigen (RSV_A F(+)FdTHS) stabilized by engineered disulfide bond mutations S155C and S290C ("DS"), cavity-filling mutations S190F and V207L ("Cav1"), and appended C-terminal heterologous trimerization domain (Fd). The D25-bound RSV F structure is shown with two of the protomers displayed as a molecular surface colored pink and tan, and the third protomer displayed as ribbons. The N- and C-terminal residues of $F_1$ that move more than 5 Å between the pre and postfusion conformations are shown. Insets show the engineered disulfide bond between residues S155C and S290C (named "DS"), as well as the space-filling cavity mutations S190F and V207L (named "Cav1"). A model of the T4 phage fibritin trimerization domain is shown at the base of the prefusion trimer. The RSV F protein including the S155C and S290C, and S190F and V207L substitutions in human RSV subtype A, and the appended C-terminal heterologous Foldon domain, is termed RSV_A F(+)FdTHS DSCav1. Mutations compatible with D25 recognition, but insufficiently stable to allow purification as a homogenous trimer, are labeled and shown in black stick representation.

FIG. 16 shows the design of a recombinant RSV F protein stabilized by engineered disulfide bond mutations S155C and S290C (termed "DS"), cavity-filling mutations S190F and V207L (termed "Cav1"), and a heterologous trimerization domain appended to the C-terminus of the F1 polypeptide of the F protein. The three-dimensional structure depicted is the D25-bound RSV F structure, and is shown with two of the protomers displayed as a molecular surface colored pink and tan, and the third protomer displayed as ribbons. The N- and C-terminal residues of $F_1$ that move more than 5 Å between the pre and postfusion conformations are shown. Insets show the engineered disulfide bond between residues S155C and S290C, as well as the space-filling cavity mutations S190F and V207L. A model of the T4 phage fibritin trimerization domain is shown at the base of the prefusion trimer.

A RSV F protein including the S155C, S290C, S190F and V207L (Cav1) substitutions in human RSV subtype A, and the appended C-terminal heterologous foldon domain, was expressed and purified using methods described in Example 1 and 5, and is termed RSV_A F(+)FdTHS DSCav1.

The antigenic characterization of RSV_A F(+)FdTHS DSCav1 are shown in FIG. 17. The association and dissociation rates of soluble D25, AM22, 5C4, 101F, Motavizumab, and Palivizumab Fab with immobilized RSV_A F(+)FdTHS DSCav1 were measured using an OctetRED 384™ instrument (ForteBio, Melno Park, Calif.). Equilibrium dissociation constants for each antibody are provided.

Figures 18, 19:
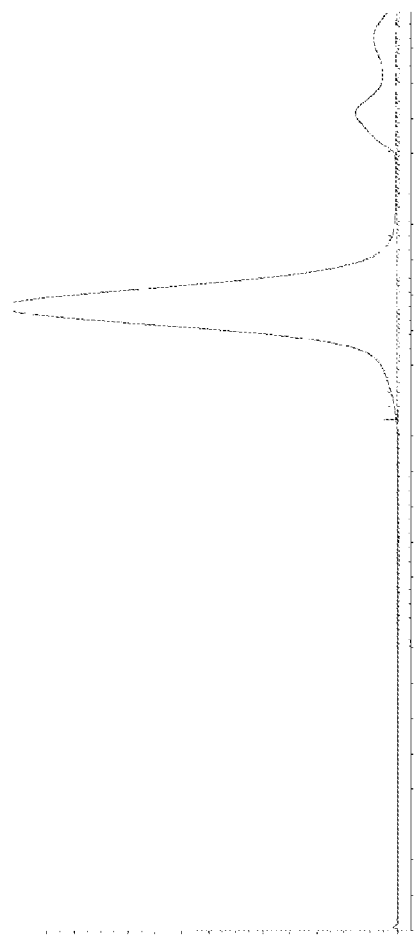
FIG. 18 shows size exclusion chromatography of RSV_A F(+)FdTHS DSCav1. Purified protein, after thrombin cleavage to remove the tags, was passed over a 16/70 Superose 6 size exclusion column. The elution volume is consistent with a glycosylated trimer.
FIG. 19 shows a table listing antigenic and physical characteristics of RSV_A F(+)FdTHS variants stabilized by DS, Cav1 or DSCav1 alterations. The left most column defines the RSV F variant, and the rest of the columns provide variant properties, including yield from transiently expressed plasmids, antigenicity against various antigenic sites, and the retention of D25-binding (provided as a fractional amount) after 1 hour of incubation at various temperatures, pHs, and osmolality, or to 10 cycles of freeze-thaw. The DSCav1 variant retains antigenic site Ø recognition, with improved physical stability, as judged by higher retention of D25-reactivity after exposure to extremes of temperature, pH, osmolality and freeze-thaw, then either DS or Cav1 variants.

The purity of RSV_A F(+)FdTHS DSCav1 is illustrated by size exclusion chromatography (FIG. 18). Purified protein, after thrombin cleavage to remove the tags, was passed over a 16/70 Superose 6 size exclusion column. The elution volume is consistent with a glycosylated trimer.

The antigenic and physical characteristics, including yield from transiently expressed plasmids, antigenicity against various antigenic sites, and the retention of D25-binding (provided as a fractional amount) after 1 hour of incubation at various temperatures (350 mM NaCl pH 7.0, at 50° C., 70° C., or 90° C.), pHs (350 mM NaCl pH 3.5 or pH 10, at 25° C.), and osmolality (10 mM or 3000 mM osmolarity, pH 7.0, at 25° C.), or to 10 cycles of freeze-thaw (in 350 mM NaCl pH 7.0), of RSV_A F(+)FdTHS variants stabilized by DS, Cav1 or DSCav1 mutations are shown in FIG. 19. The DSCav1 variant retains antigenic site Ø recognition, with improved physical stability, as judged by higher retention of D25-reactivity after exposure to extremes of temperature, pH, osmolality and freeze-thaw, then either DS or Cav1 variants.

Figure 20:
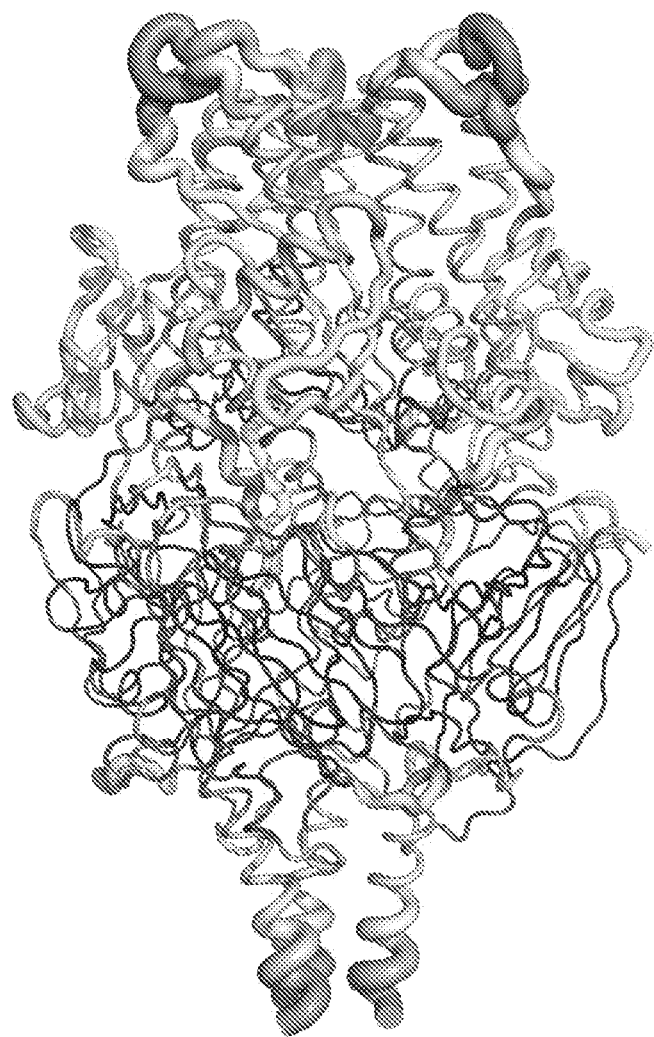
FIG. 20 shows a ribbon representation of the 3.1 Å crystal structure of RSV_A F(+)FdTHS DSCav1. Thicker ribbons correspond to increasing B-factors. Despite stabilizing mutations, antigenic site Ø, at the trimer apex, retains significant flexibility.

To investigate the structural properties of the DSCav1 mutant, the three dimensional structure of RSV_A F(+) FdTHS DSCav1 was determined using X-ray crystallography. FIG. 20 shows a ribbon representation of the 3.1 Å crystal structure of RSV_A F(+)FdTHS DSCav1. Warmer colors and thicker ribbons correspond to increasing B-factors. Despite stabilizing mutations, antigenic site Ø, at the trimer apex, retains significant flexibility. FIG. 21 shows comparison of the structure of RSV_A F(+)FdTHS DSCav1 to the structure of D25-bound RSV F. FIG. 22 highlights the stabilizing mutations in RSV_A F(+)FdTHS DSCav1 structure. Observed electron density corresponding to the disulfide bond between cysteine residues 155 and 290 (left), as well as the cavity-filling Phe190 residue (right), indicates that these modifications are present in the crystal.

Figure 23:
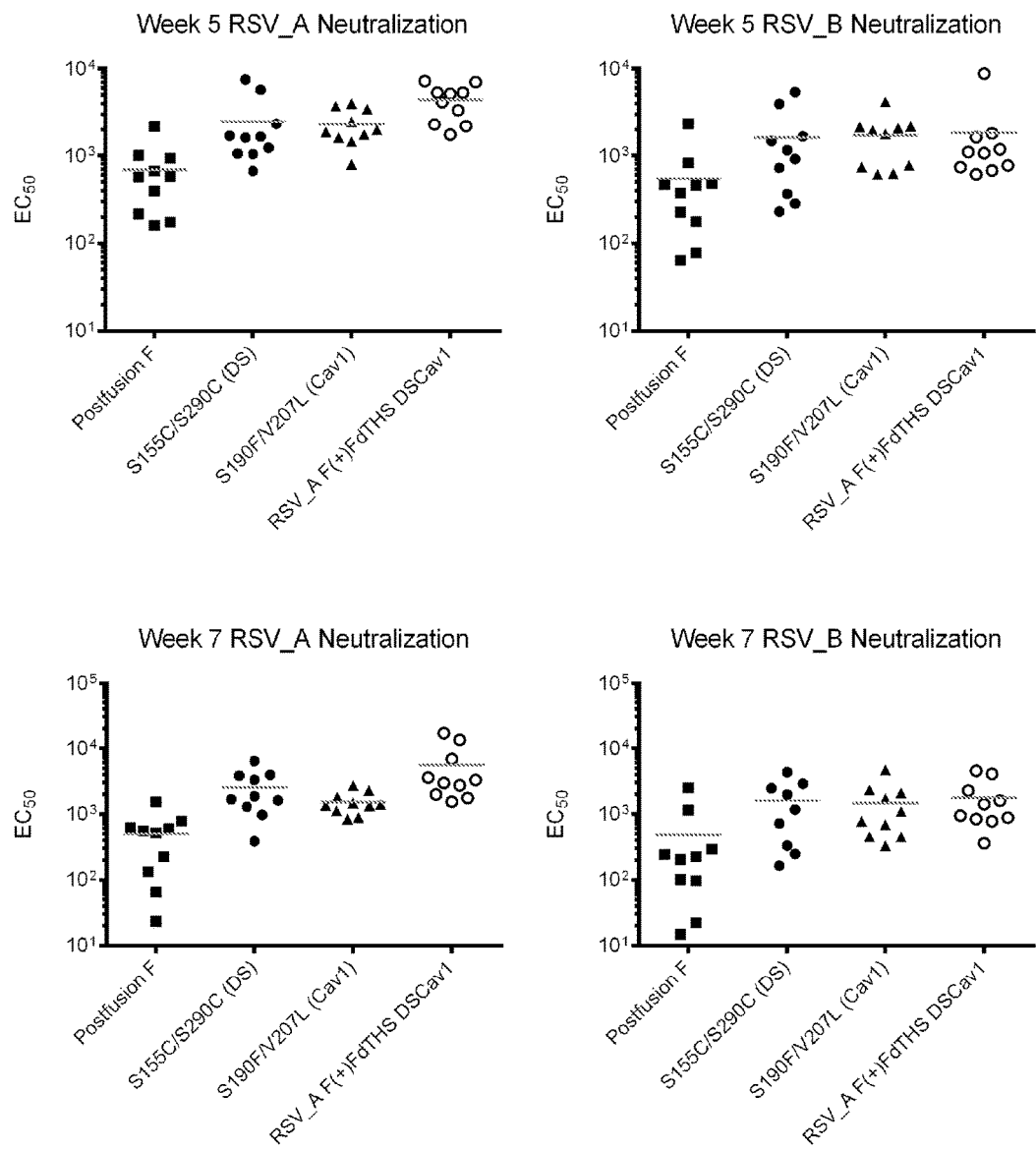
FIG. 23 shows mouse immunogenicity of RSV_A F(+) FdTHS DSCav1. Ten CB6 mice per group were immunized with 10 μg of RSV_A F(+)FdTHS DSCav1 protein mixed with 50 μg of poly I:C adjuvant. Immunizations occurred at 0 and 3 weeks, and sera from week 5 and week 7 were tested for neutralization of RSV subtype A (RSV_A) and B (RSV_B). Mean values are indicated by horizontal lines.
Figure 24:
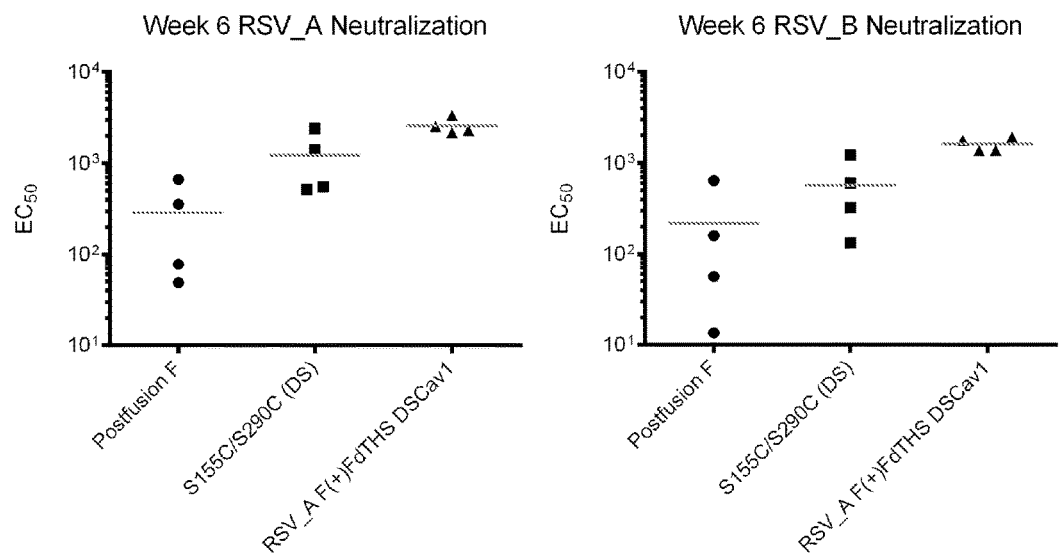
FIG. 24 shows non-human primate (NHP) immunogenicity of RSV_A F(+)FdTHS DSCav1. Four RSV-naïve rhesus macaques per group were immunized with 50 μg of RSV_A F(+)FdTHS DSCav1 protein mixed with 500 μg of poly I:C adjuvant Immunizations occurred at 0 and 4 weeks, and sera from week 6 were tested for neutralization of RSV subtype A (left) and B (right). Mean values are indicated by horizontal lines.
Figure 25A:
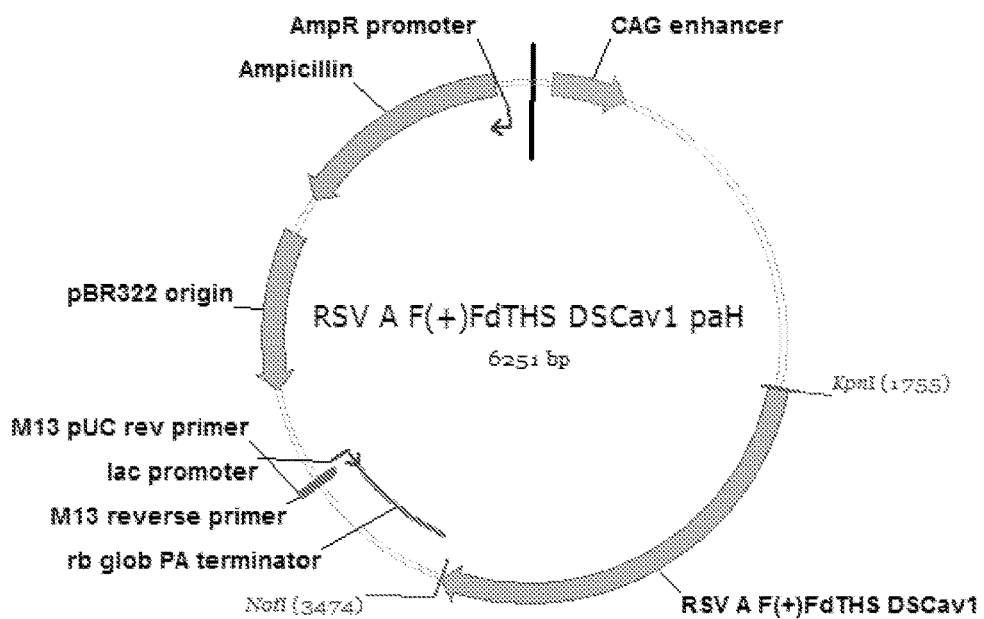
FIGS. 25A-25C show plasmid maps of expression vectors. (A) A map of the RSV_A F(+)FdTHS DSCav1 paH expression vector (SEQ ID NO: 384) for expressing recombinant RSV F protein from human subtype A including S155C, S290C, S190F and V207L amino acid substitutions, fused to a C-terminal Foldon domain, thrombin cleavage site, 6×His tag and a StrepTag II. (B) A map of the RSV_B (B1) F(+)FdTHS DSCav1 paH expression vector (SEQ ID NO: 386) for expressing recombinant RSV F protein from human subtype B (strain B1) including S155C, S290C, S190F and V207L amino acid substitutions, fused to a C-terminal Foldon domain, thrombin cleavage site, 6×His tag and a StrepTag II. (C) A map of the RSV_B (18537) F(+)FdTHS DSCav1 paH expression vector (SEQ ID NO: 388) for expressing recombinant RSV F protein from human subtype B (strain 18537) including S155C, S290C, S190F and V207L amino acid substitutions, fused to a C-terminal Foldon domain, thrombin cleavage site, 6×His tag and a StrepTag II.
Figure 25B:
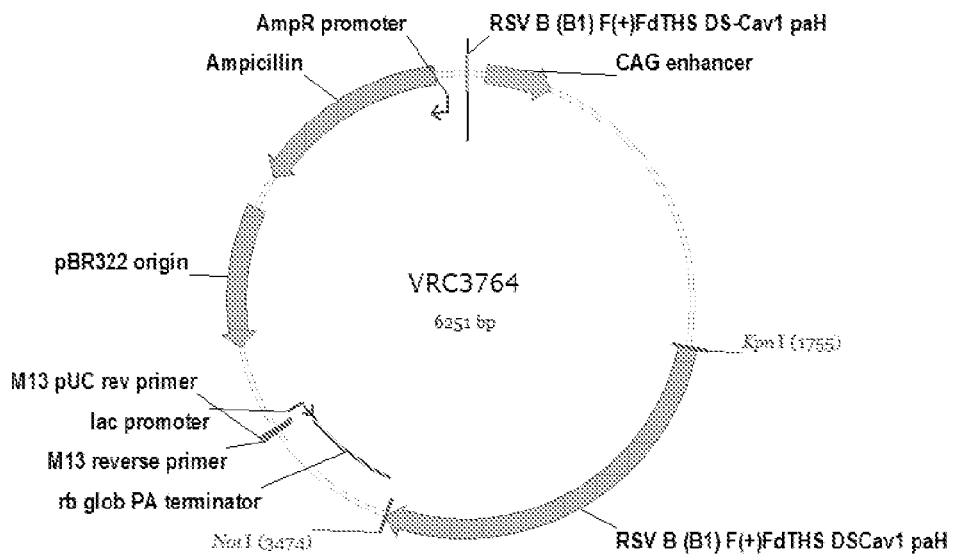
Figure 25C:
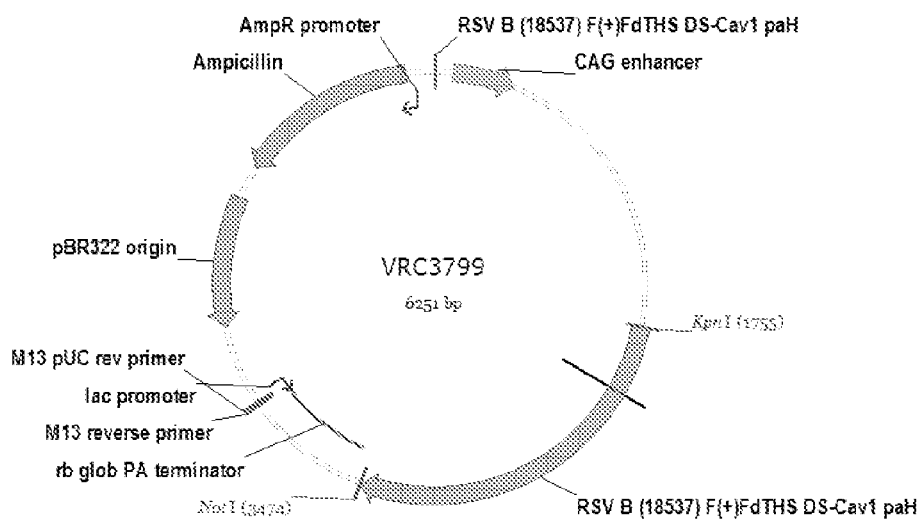

To determine the immunogenicity of the RSV_A F(+) FdTHS DSCav1 construct, mice and non-human primates were inoculated with this construct and sera obtained from the inoculated animals was tested for neutralization of RSV (FIGS. 23 and 24). Mice were immunized, and the neutralization activity of the resulting sera was tested, as described in Example 6, above. Briefly, ten CB6 mice per group were immunized with 10 µg of the indicated RSV F protein mixed with 50 µg of poly I:C adjuvant Immunizations occurred at 0 and 3 weeks, and sera from week 5 and week 7 were tested for neutralization of RSV subtype A (RSV_A) and B (RSV_B). Mean values are indicated by horizontal red lines. *Macaca mulatta* animals of Indian origin weighing 8.76-14.68 kg were intramuscularly injected with immunogens at week 0 and week 4. Blood was collected every other week for up to 6 weeks. Four RSV-naïve rhesus macaques per group were immunized intramuscularly with 50 µg of the indicated RSV F protein mixed with 500 µg of poly I:C adjuvant Immunizations occurred at 0 and 4 weeks, and sera from week 6 were tested for neutralization of RSV subtype A (left) and B (right). Mean values are indicated by horizontal red lines. Taken together, these results show that the RSV_A F(+)FdTHS DSCav1 construct successfully generated a neutralizing response in mice and non-human primates.

Example 9

Structure-Based Design of a Fusion Glycoprotein Vaccine for Respiratory Syncytial Virus Abstract.

Respiratory syncytial virus (RSV) is the leading cause of hospitalization for children under five years of age. To elicit protective humoral responses against RSV, efforts were focused on antigenic site Ø, a metastable site specific to the prefusion state of the fusion (F) glycoprotein, as this site is the principal target of highly potent RSV-neutralizing antibodies elicited by natural infection. Structure-based design to engineer stabilized versions of F that preserved antigenic site Ø to extremes of pH and temperature was used. Six stabilized-F crystal structures provided atomic-level details for introduced cysteine residues and filled hydrophobic cavities and revealed subtly different "prefusion" F conformations Immunization with site Ø-stabilized variants of RSV F elicited—in both mice and non-human primates—RSV-specific neutralizing activity 3-15-fold higher than those elicited by RSV F in its postfusion state. Atomic-level design to present a supersite of viral vulnerability can thus have a transformative effect on vaccine development.

Introduction.

Respiratory syncytial virus (RSV) is estimated to be responsible for 6.7% of deaths in children 1 mo-1 yr of age and causes excess mortality in the elderly at levels comparable to that caused by infection with influenza virus. Although RSV infection does not induce fully protective immunity, antibodies against the RSV fusion (F) glycoprotein can prevent severe disease in humans as demonstrated by passive prophylaxis with the F-directed antibody, palivizumab (Synagis®).

The proven success of palivizumab has spurred vaccine efforts aimed at eliciting protective RSV F-directed antibodies. These efforts have been complicated by the structural diversity of RSV F, a type I fusion protein that assumes at least two conformations: a metastable prefusion state and a stable postfusion state. Both states share epitopes targeted by neutralizing antibodies, including that of palivizumab, and postfusion RSV F is being developed as a vaccine candidate. As described herein, the dominant target of RSV-neutralizing antibodies elicited by natural infection was found to reside primarily on the prefusion conformation of RSV F, and antibodies such as AM22, and D25 (see, e.g., U.S. Ser. No. 12/600,950, and U.S. Ser. No. 12/898,325)—substantially more potent than palivizumab—target antigenic site Ø, a metastable site specific to prefusion F, which is located at the membrane-distal apex of the prefusion RSV F trimer.

To enhance elicitation of these potent antibodies, engineered soluble variants of RSV F were designed to stably expose antigenic site Ø. These variants were characterized both antigenically and crystallographically, and tested for immunogenicity in mice and non-human primates. The results provide insight into the interplay between design, antigenicity, structure, and immunogenicity and show how structure-based engineering to preserve and to present an appropriate antigenic target can have a transformative effect on the elicitation of protective humoral responses.

The structure-based vaccine strategy described herein included a four step strategy: (1) to identify a supersite of viral vulnerability targeted by antibodies with potent neutralizing activity, (2) to determine the structure of the supersite in complex with a representative antibody, (3) to engineer the stable presentation of the supersite in the absence of recognizing antibody, and (4) to elicit high titer protective responses through immunization with engineered antigens that present the supersite (FIG. 26).

Engineering of RSV F Antigens

Because of its recognition by extraordinarily potent RSV-neutralizing antibodies, antigenic site Ø was chosen as the target supersite; its structure in complex with the D25 antibody is described herein (FIG. 26B). To engineer variants of RSV F that stably presented site Ø, the structure of RSV F bound by D25 was analyzed. Mechanistically, there are a number of ways to stabilize a protein conformation. Mechanisms to stabilize site Ø without compromising its recognition were tested these in combination with a T4-phage fibritin trimerization domain ("foldon") (Efimov et al., J Mol Biol 242, 470 (1994); Boudko et al., European journal of biochemistry/FEBS 269, 833 (2002)) appended to the C-terminus of the RSV F ectodomain (McLellan et al., J. Virol. 85, 7788 (2011)).

Introducing cysteine pairs predicted to form a disulfide bond in the target conformation, but widely separated in alternative conformations, is one approach to stabilize a select structure. The β-carbons of serine residues 155 and 290 are 4.4 Å apart in the D25-bound RSV F structure (see Example 1) and 124.2 Å apart in the postfusion structure (McLellan et al., J. Virol. 85, 7788 (2011; described above and see FIGS. 27 and 32). A S155C-S290C double mutant, termed named "DS", formed stable RSV F trimers, expressed at 1.4 mg/L, retained antigenic site Ø, and was homogeneous as judged by negative stain EM (described above; see also FIG. 31, FIG. 33). Other cysteine modifications, such as those between regions of RSV F that are compatible with both the pre- and postfusion states (e.g. S403C and T420C), did not stabilize antigenic site Ø (FIG. 31). a number of potential inter-subunit double cysteine modifications was also tested; none of the tested inter-subunit double cysteine substitutions, however, expressed more than 0.1 mg/L.

Cavity-filling hydrophobic substitutions provide another means to stabilize a select conformation. The D25-bound RSV F structure was analyzed for hydrophobic cavities unique to the D25-bound conformation of RSV F that abutted regions that differed in pre- and postfusion F states. A number of such cavities were identified in the membrane-distal "head" of the prefusion structure, close to the binding site of D25, and modeled hydrophobic alterations to fill these cavities. S190F and V207L alterations adopted prevalent side chain conformations with minimal clashes, while K87F, V90L, V220L and V296F alterations showed less steric compatibility. filling these cavities with pairs of changes was assessed. A S190E-V207L pair, which was named "Cav1" (FIG. 27), formed stable RSV F trimers, expressed at 2.2 mg/L, and retained antigenic site Ø (FIG. 31). Meanwhile, K87F-V90L, S190E-V296F and V207L-V220L variants showed enhanced retention of D25 recognition, but less than 0.1 mg/l yields of RSV F trimer (FIG. 31).

Figure 27:
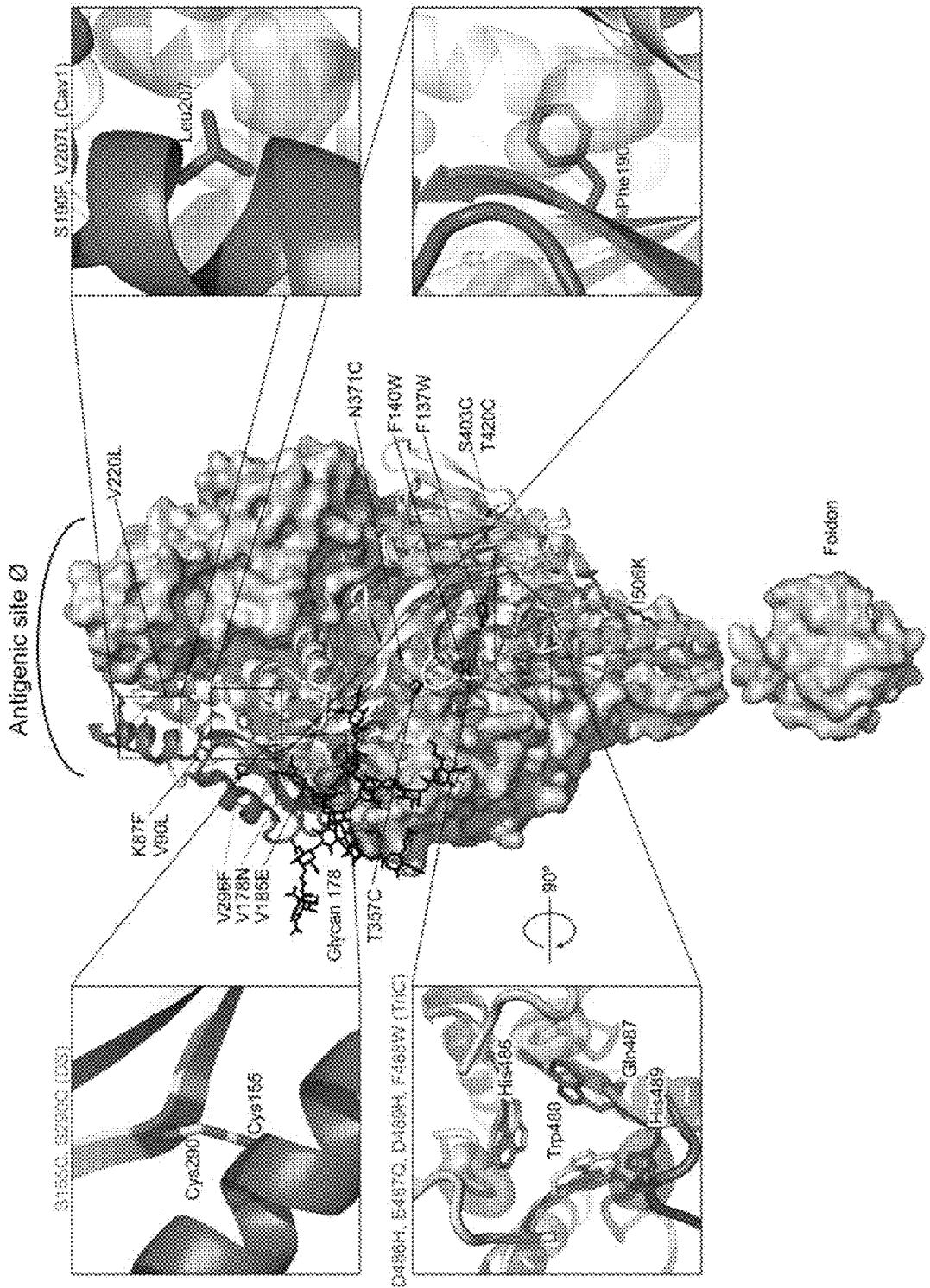
FIG. 27 shows design of soluble trimeric site Ø-stabilized RSV Fs. Over 100 variants of RSV F containing the T4 fibritin-trimerization domain (foldon) were designed to more stably retain antigenic site Ø. Shown here is the structure of the RSV F trimer in its D25-bound conformation with modeled foldon. The trimer is displayed with two protomers as molecular surfaces shaded light grey tan and pink, and the third promoter as ribbons. The ribbon is shaded white in regions where it is relatively fixed between pre- and postfusion, while the N- and C-terminal residues that move more than 5 Å between pre- and postfusion conformations are shaded darker grey. Mutations compatible with expression and initial D25 recognition, but insufficiently stable to allow purification as a homogenous trimer are labeled and shown in black stick representation. Insets show close-ups of stabilizing mutations in stick representation for DS, Cav1 and TriC variants, all of which stably retain antigenic site Ø (FIG. 31).

Other cavities towards the center of prefusion RSV F were close to the fusion peptide, the trimer axis, and an acidic patch comprising residues Asp486, Glu487, and Asp489. A number of cavity-filling alterations were modeled including F137W, F140W, and F488W, and analyzed these alterations in combination with D486H, E487Q, and D489H (FIG. 31). Of the six combinations tested, only two (F488W and D486H-E487Q-F488W-D489H) expressed levels of purified RSV F trimer at greater than 0.1 mg/l and retained D25 recognition. The D486H-E487Q-F488W-D489H variant, designated "TriC", formed stable RSV F trimers, expressed at 0.8 mg/1, and retained antigenic site Ø (FIG. 31, FIG. 27).

Figure 34:
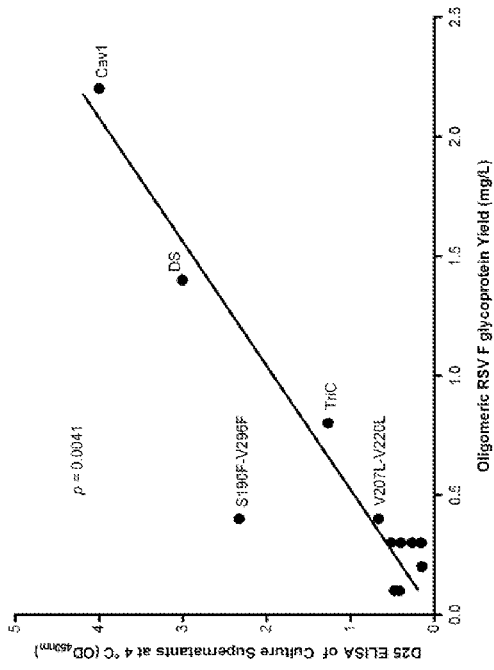
FIG. 34 shows the antibody D25 based ELISA of the crude culture supernatants is correlated (Spearman R=0.7752 and a P value=0.0041) to the yield of purified oligomeric RSV F glycoprotein variants. RSV F glycoprotein production by 293 Expi cells was determined by D25 ELISA of the crude culture supernatants at 4° C. one week after harvesting and found to correlate with the yield of pure oligomeric RSV F glycoprotein variants (Table 1).

The impact of destabilizing the postfusion conformation on the preservation of antigenic site Ø was also tested. V178N, predicted to introduce an N-linked glycan compatible with the prefusion but not the postfusion conformation of F, did not appear to stabilize antigenic site Ø, nor did V185E or I506K, which would place a glutamic acid or a lysine into the interior of the postfusion six-helix bundle (FIG. 31). These mutations likely result in some intermediate conformation of RSV F that is "triggered", but is unable to adopt the postfusion conformation. In all, over 100 RSV F variants were constructed, expressed in a 96-well transfection format (Pancera et al., PLoS ONE 8, e55701 (2013)), and tested by ELISA for binding to D25 and motavizumab. Fifteen constructs were compatible with D25 binding, six of which retained D25 recognition for at least 7 days at 4° C., and three of these could be purified to homogeneous trimers that retained antigenic site Ø (FIG. 31). Overall, a strong correlation was observed between retention of D25 binding for at least 7 days at 4° C. in 96-well supernatants and yield of purified trimers from large scale expression and purification (FIG. 34).

Combinatorial Optimization of Site Ø Stability

DS, Cav1, and TriC variants displayed a variety of physical and antigenic properties. The DS variant was the least stable to pH and temperature extremes, but more permanently stabilized in the trimeric state, while constant interconversion from trimer to aggregate was observed for Cav1 and TriC. To assess whether a more optimal variant of RSV F might be obtained by combining DS, Cav1, and TriC, all combinations were made.

Figure 35:
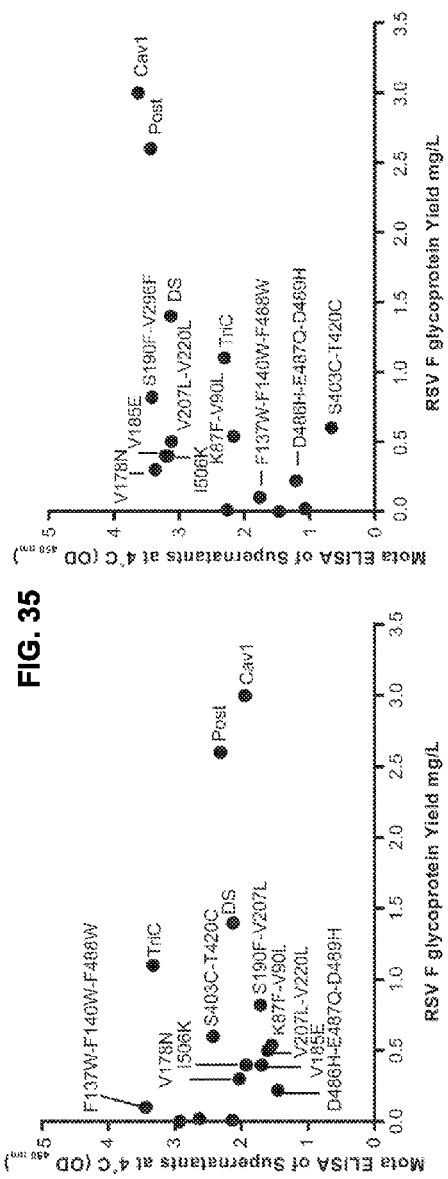
FIG. 35 shows the antibody motavizumab based ELISA of the crude culture supernatants versus the yield of purified RSV F glycoprotein variants. (A) RSV F glycoprotein production by 293 Expi cells was determined by motavizumab ELISA of the crude culture supernatants at 4° C. immediately upon harvest and (B) one week after harvesting. ELISA data is plotted versus the yield of RSV F glycoprotein variants after streptactin affinity. Interestingly, three proteins, RSV F(+) Fd and two variants F137W-F140W and T357C-N371C were detected as high expressers by motavizumab ELISA but low yields were obtained after large scale purification (points shown along the ordinate).
Figure 36:
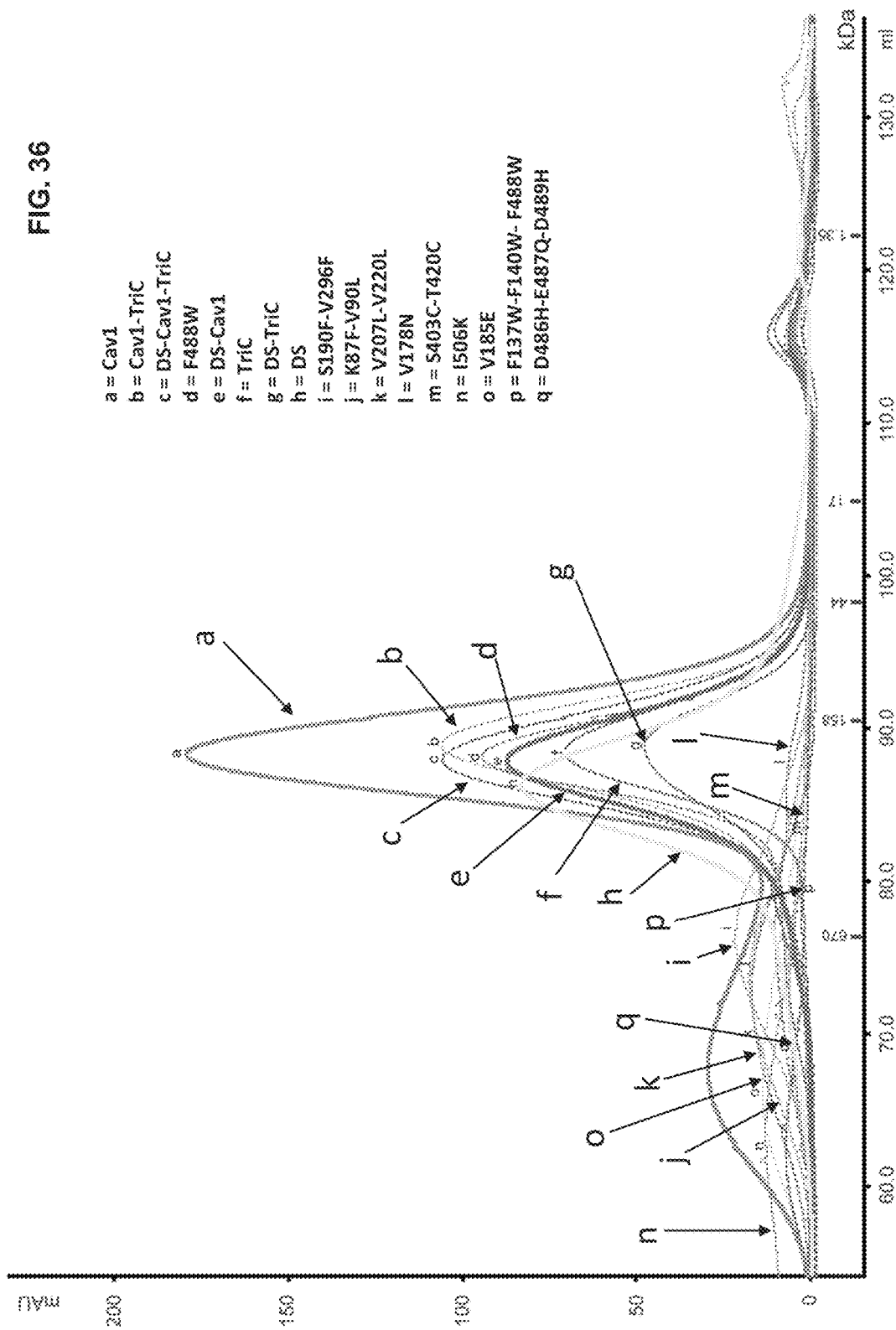
FIG. 36 shows the characterization of engineered RSV F glycoproteins using size exclusion chromatography. RSV F variants, a: Cav1; b: Cav1-TriC; c: DS-Cav1-TriC; d: F488W; e: DS-Cav1; f: TriC, g: DS-TriC; h: DS; exhibit elution profiles characteristic of a globular trimeric protein, whereas RSV F variants i: S190E-V296F; j: K87F-V90L; k: V207L-V220L; l: V178N; m: S403C-T420C; n: I506K; o: V185E; p: F137W-F140W-F488W; q: D486H-E487Q-D489H exhibit elution profiles characteristic of higher oligomeric species. Protein standards of known molecular weight are labeled on the base of the chromatogram.
Figure 37:
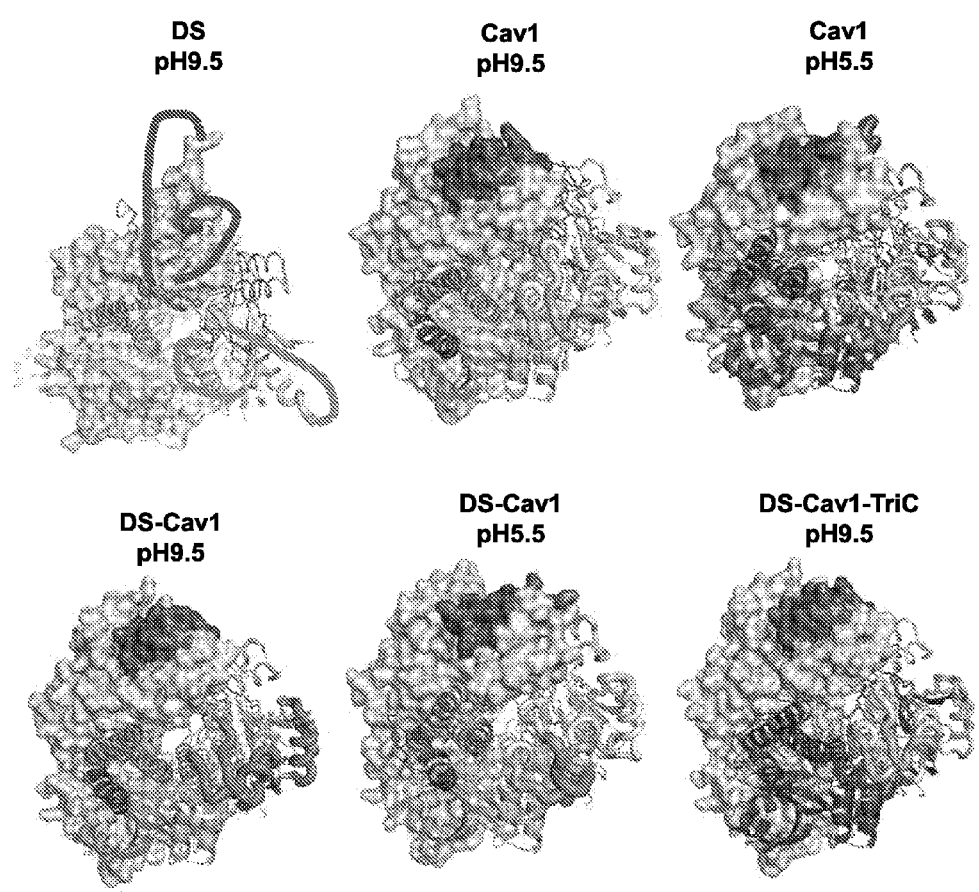
FIG. 37 shows antigenic site Ø shown from above. The regions of DS which are not visible are represented by dotted lines.

Combinations generally improved retention of D25 reactivity to physical extremes. Thus, for example, all combinations showed improved stability to incubation at 50° C. or pH 10.0. However, the low tolerance to freeze-thaw exhibited by TriC was also observed in both Cav1-TriC and DS-Cav1-TriC. Overall, the DS-Cav1 combination appeared optimal in terms of trimer yield and physical stability to extremes of temperature, pH, osmolality, and freeze-thaw (FIG. 31, FIG. 35), and was homogeneous as judged by negative stain EM (FIG. 33).

Crystallographic Analysis

Figure 28A:
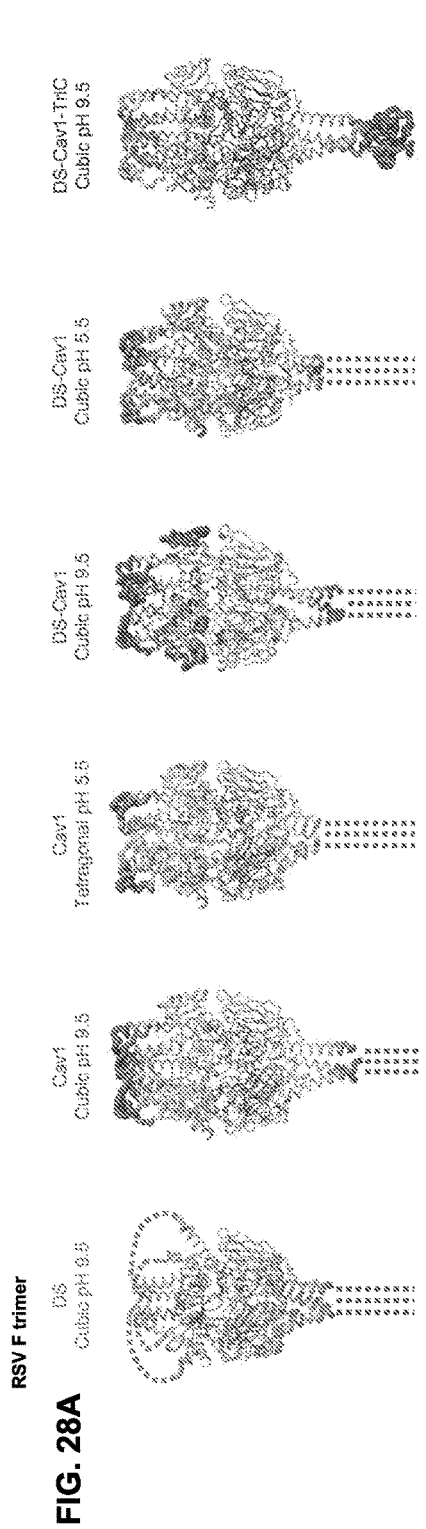
FIGS. 28A-28C show structures of RSV F trimers, engineered to preserve antigenic site Ø. (A-C) Six structures for RSV F variants are shown, labeled by stabilizing mutation (DS, Cav1, DS-Cav1, and DS-Cav1-TriC) and by the lattice (cubic and tetragonal) and crystallization pH. (A) RSV F trimers are displayed in Cα-worm representation, colored according to atomic mobility factor. Missing regions are shown as dotted lines. These occur at the C-terminal membrane-proximal region, where the foldon motif is not seen, except in the DS-Cav1-TriC structure (far right). In the DS structure, two loops in the head region are also disordered. (B) Antigenic site Ø of a RSV F protomer is displayed in ribbon diagram, with the structure of D25-bound RSV F in gray and different variants indicated. Stabilizing mutations are labeled and shown in stick representation. (C) Atomic-level details are shown in stick representation, with regions of RSV F that change conformation between prefusion and postfusion conformation in dark grey, and those that remain constant in lighter gray. Stabilizing carbon atoms for stabilizing mutations are indicated. In Cav1 (pH5.5) and in DS-Cav1 (pH5.5) novel features were observed involving the interaction of the C-terminus of the $F_2$ peptide with a sulfate ion and the fusion peptide. In the DS-Cav1-TriC structure, the D486H-E487Q-F488W-D489H mutations interact with the two neighboring protomers around the trimer axis.

To provide atomic-level feedback, crystal structures of site Ø-stabilized variants of RSV F were determined (FIG. 28). The DS, Cav1, DS-Cav1 and DS-Cav1-TriC variants all crystallized in similar 1.5 M tartrate pH 9.5 conditions, and these cubic crystals diffracted X-rays to resolutions of 3.1 Å, 3.1 Å, 3.8 Å and 2.8 Å resolutions, respectively (FIG. 40). Molecular replacement solutions were obtained by using the D25-bound RSV F structure as a search model, and these revealed a single RSV F protomer in the asymmetric unit, with the trimeric F axis aligned along the crystallographic threefold. Tetragonal crystals of Cav1 and cubic crystals of DS-Cav1 were also obtained from 1.7 M ammonium sulfate pH 5.5 conditions, and these diffracted to resolutions of 2.4 Å and 3.0 Å, respectively (FIG. 40). Molecular replacement revealed the tetragonal lattice to have a full RSV F trimer in the asymmetric unit, and to be highly related to the tartrate cubic lattices. Overall these structures revealed the engineered RSV F variants to be substantially in the D25-bound conformation (The engineered RSV F variants had C-root mean square deviations from the D25-bound conformation between 0.68-1.5 Å and from the postfusion conformation of approximately 30 Å).

Figure 28B:
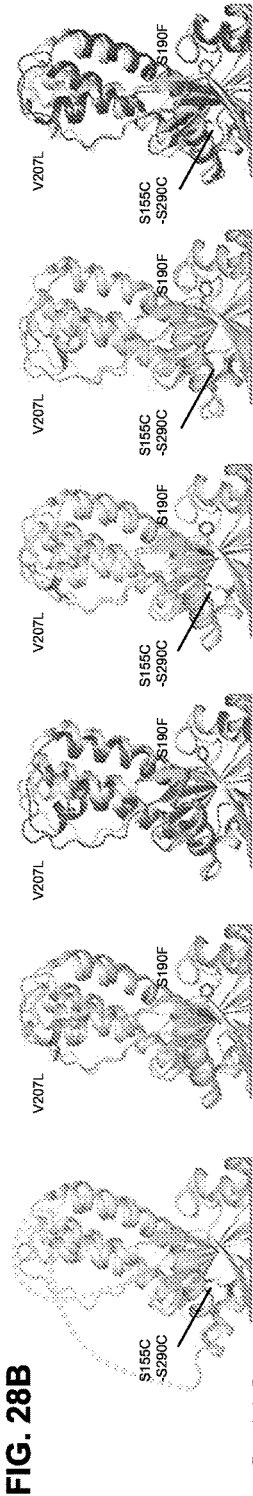

Although the structure of the DS variant (FIG. 28, left most column) was stable as a soluble trimer, with the cysteine substituted residues at 155 and 290 indeed forming a disulfide bond that largely prevented triggering to the postfusion state, much of the membrane-distal portion of the RSV F trimer, including antigenic site Ø, was either disordered (residues 63-72 and 169-216) or in a different conformation. Thus, for example, residues 160-168 in the DS structure extend the α2-helix instead of forming a turn and initiating the α3-helix as in the D25-bound F structure (FIG. 28B, left most panel). One non-limiting explanation for the differences between DS structure and the D25-bound RSV F structure is that the crystallized DS is in a conformation that does not bind D25. Overall the DS variant retained many of the features of the prefusion state of RSV F, including the fusion peptide in the interior of the trimeric cavity.

In comparison to DS, the Cav1 structure (FIG. 28, $2^{nd}$ and $3^{rd}$ columns) was more ordered in the membrane-distal apex, with the α3-helix, β3/β4 hairpin, and the α4-helix clearly defined. Residues 137-202, which contain the S190F substitution, had a Cα-rmsd of 0.6 Å when compared to the D25-bound F structure. The higher degree of structural order was likely due to the S190F mutation that filled a cavity observed in the D25-bound F structure, and increased van der Waal's contacts with residues Ile57, Lys176, Val192, Glu256, Ser259 and Leu260. The other cavity-filling mutation in Cav1, V207L, was shifted by 5.5 Å compared to the D25-bound F structure, with the C-terminal portion of the α4-helix kinking near Pro205 and adopting distinct conformations in the two crystallization conditions (FIG. 28B, $2^{nd}$ and $3^{rd}$ panels from left).

Figure 28C:
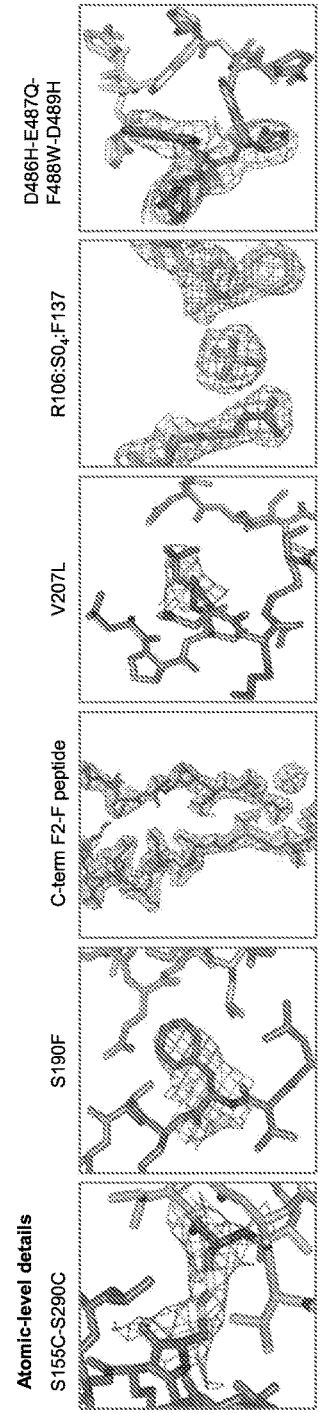

A striking feature of the Cav1 structure in the tetragonal crystal lattice is the C-terminus of F2, which is disordered in the D25-bound F structure, but in Cav1, tunnels into the trimeric cavity alongside the fusion peptide. Interestingly, the C-terminus ends with Ala107, and not Arg109, as expected after cleavage of the furin site (Arg106-Ala107-Arg108-Arg109). In the Cav1 structure, the positive charge of Arg106 is offset by an ordered sulfate ion (FIG. 28C).

Biologically, the interior position of the F2 C-terminus may play a role in triggering of the prefusion F conformation.

Comparison of the DS-Cav1 structures from the two tetragonal crystal forms (FIG. 28, $2^{nd}$ and $3^{rd}$ columns from right) to those of Cav1 revealed only minor differences (Cα rmsd of 0.86 Å for residues between Cav1 and DS-Cav1 grown in ammonium sulfate conditions; Cα rmsd of 0.47 Å for 447 residues in the cubic lattice). The largest differences occurred at the RSV F apex, including antigenic site 0 and specifically at residues 64-73 and 203-216. Notably, the atomic mobility (B-factor) was highest in this apex region for all of the site Ø-stabilized variants, perhaps indicative of intrinsic site Ø flexibility. Interestingly, however, site Ø has low atomic mobility when bound by D25, revealing the ability of D25 to stabilize both overall and local RSV F conformations.

The structure of the DS-Cav1-TriC triple combination (FIG. 28, far right column) was also highly similar to other Cav1-containing RSV F variant structures. One difference in the electron density, however, corresponded to an expanse of weak density at the membrane-proximal region, which corresponded to the dimensions of the T4-fibritin trimerization domain (Stetefeld et al., Structure 11, 339 (2003)), which is not visible in other crystallized RSV F structures which contained this domain, including the D25-bound structure. Small structural differences in packing likely allow for the partial ordering of this domain (and may also account for its increased diffraction limit of the DS-Cav1-TriC crystals relative to the other cubic variants), rather than differences in the interaction between the DS-Cav1-TriC stabilized RSV F and this trimerization domain.

In terms of the TriC alterations of residues 486-489, the critical F488W substitution packed directly against the F488W substitutions of neighboring protomers of the RSV F trimer. The indole side chain of Trp488 pointed towards the trimer apex and also formed ring-stacking interactions with the side chain of 140Phe of the fusion peptide (FIG. 28C, far right panel). This fusion peptide interaction, which is not observed in any of the Phe488-containing structures, likely inhibits the extraction of the fusion peptide from the prefusion trimer cavity, providing a structural rationale for the ability of the F488W alteration to stabilize the prefusion state of RSV F (FIG. 31).

Immunogenicity of Antigenic Site Ø-Stabilized RSV F

To assess the effect of site Ø-stabilization on the elicitation of RSV-protective humoral responses, CB6 mice were immunized with various forms of RSV F, injecting each mouse with 10 µg RSV F combined with 50 µg poly I:C adjuvant at weeks 0 and 3, and measured the ability of week 5 sera to prevent RSV infection of HEp-2 cells. DS, Cav1, and TriC each elicited high titers of neutralizing activity (geometric mean 50% effective concentrations ($EC_{50}s$) of 1826-2422). This level was ~3-fold higher than elicited by postfusion F (504 $EC_{50}$), and ~20-fold higher than the protective threshold. By comparison, DS-Cav1 elicited neutralizing activity of 3937 $EC_{50}$, roughly 7-fold higher than postfusion F and 40-fold higher than the protective threshold (FIG. 29A). (When palivizumab (Synagis®) is dosed at a concentration of 15 mg/kg, serum levels at trough are ~40 µg/ml, which provides protection in infants from severe disease. In the neutralization assay, 40 µg/ml of palivizumab in serum yields an EC50 of 100. This titer is also associated with complete protection from lower respiratory tract infection in mice and cotton rats challenged with RSV.)

To quantify the elicitation of antibodies between different sites on prefusion RSV F, antigenic site Ø-occluded forms of RSV F were utilized. CB6 mice immunized with 20 µg RSV F bound by antigenic site Ø-directed antibodies (comprising ~10 µg of RSV F and ~10 µg of the antigen-binding fragment of antibody) developed week 5 geometric mean neutralizing titers of 911 and 1274 $EC_{50}$ for AM22 and D25 complexes, respectively, roughly double that of postfusion at 10 µg/ml and comparable to those elicited by postfusion at 20 µg/ml (FIG. 29A). These findings suggest that the very high titers elicited by immunization with RSV F variants stabilized in the prefusion state—especially DS-Cav1—were due to antibodies targeting antigenic site Ø.

To examine the generality of site Ø elicitation, rhesus macaques were immunized with DS-Cav1, DS and postfusion forms of RSV F, injecting each macaque with 50 µg RSV F mixed with 500 µg poly I:C adjuvant at weeks 0 and 4 and measuring the ability of week 6 sera to inhibit RSV infection. Formulated proteins retained expected antigenic profiles as measured by D25 binding (FIG. 38). DS and DS-Cav1 elicited geometric mean titers of 1222 and 2578 $EC_{50}$, respectively, roughly 5- and 10-fold higher than postfusion F (287 $EC_{50}$) (FIG. 29B), thereby demonstrating a conservation of the relative immunogenicity for the different forms of RSV F immunogen between mice and primates, and the ability of DS-Cav1 to generate high RSV-protective titers in a primate immune system.

Optimization of RSV F Protective Responses

The matrix of information (FIG. 26C) generated by the interplay between design, physical and antigenic properties, atomic-level structure, and immunogenicity provides a basis for further optimization (Nabel, Science 326, 53 (2009)). For example, to obtain insight into the relationship between various antigenic and physical properties of engineered RSV Fs and the elicitation of RSV-protective responses, one can correlate properties (FIG. 31) with immunogenicity (FIG. 29). Such correlations indicate that increasing site Ø stability to physical extremes (but not trimer yield nor D25 affinity) should increase protective titers elicited upon immunization (FIG. 30A), thereby providing design insight into further optimization. Similarly, correlations between various conformational states or regions of RSV F (FIG. 28) and immunogenicity (FIG. 29) provide design insight into the conformation of RSV F that provides the most protective responses. In this case, the results indicate that enhancing structural mimicry of antigenic site Ø in its D25-bound conformation should lead to improved protective titers (FIG. 30B).

In addition to providing direction for improvement, the matrix of information can also provide an estimate for the degree that such improvement can occur. That is, once a correlation has been established say between physical stability or structural mimicry and protective responses, one can maximize physical stability (e.g. to 100% retention of D25 binding) or structural mimicry (e.g. to exact mimicry of the D25-bound conformation) to gain an idea of the maximal improvement of the elicited protective response relative to that particular parameter. These results (FIG. 30A,B) suggest that additional structural mimicry would likely not have much effect on immunogenicity, but additional physical stabilization of antigenic site Ø might substantially improve the antigenic quality of the protective titers. Independent parameters such as adjuvant, multimerization, or immunization regimes are likely to allow improvement of the elicited response, and such parameters can be independently analyzed and optimized (Flexibility of an antigenic site may increase its immunogenicity by allow the site to conform to a wider diversity of antibodies. We note in this context that the atomic-mobility factors of antigenic site Ø were among the highest in the RSV F ectodomain).

Experimentally mixing parameters can also provide insight. For example, to determine the focus of RSV F-elicited sera, immunogenicity can be interrogated antigenically (FIG. 30C). To measure the antigenicity of sera elicited by different forms of RSV F, the different forms of RSV F were coupled to an Octet biosensor tip, and measured the reactivity of elicited sera as well as "preabsorbed" sera, to which different forms of RSV Fs had been added (FIG. 30C). With DS-Cav1 on the sensor, biosensor responses to postfusion F-, DS-, and DS-Cav1-immunized macaques showed increasing responses (FIG. 30C, left panel); with postfusion F on the sensor, biosensor responses to the same sera showed decreasing responses (FIG. 30C, right panel); and with sera that had been preabsorbed with postfusion F and with DS-Cav1 on the sensor, responses from postfusion F-, DS- and DS-Cav1-immunized macaques trending with elicited titers of protection (FIG. 30C left panel). Overall, elicited $EC_{50}$ titers did not trend with antigenic responses measured against either prefusion or postfusion forms of RSV F, but did correlate with the level of prefusion-specific responses, either measured as a difference or as a ratio (p=0.005) between prefusion and postfusion RSV F-directed responses (FIG. 30D) (For the "prefusion" form of RSV F, the DS-Cav1 stabilized variant of RSV F was used). These results suggest that the quality of the immune response is substantially better for RSV F immunogens in the prefusion versus the postfusion conformation, a finding that may relate to the superior neutralization potency observed for prefusion-specific antibodies that target antigenic site Ø (it should be possible to deconvolute the elicited response, by using structurally defined probes, as shown with D25 and motavizumab-bond RSV F in FIG. 39).

Without being bound by theory, antigenic sites that contain multiple epitopes targeted by antibodies that derive from multiple germline genes may be ideal vaccine targets since these "supersites" have a high probability of eliciting multiple lineages of neutralizing antibodies. Antigenic site Ø on RSV F is an example of an antigenic supersite that is also a site of viral vulnerability. Many of the lessons learned from the efforts with RSV described herein, such as the importance of examining the natural human immune response and of selecting the appropriate target site, are likely to be generally applicable. Overall, by focusing structure-based design on supersites of vulnerability, structural vaccinology may be on the brink of achieving a paradigm-altering shift in the development of vaccines against viral pathogens.

Materials and Methods

Viruses and Cells.

Viral stocks were prepared and maintained as previously described (Graham et al., J. Med. Virol. 26, 153 (1988)). RSV-expressing Green Fluorescent Protein (GFP) RSV-GFP was constructed and provided as previously reported (Hallak et al., Virology 271, 264 (2000)). The titer of the RSV-GFP stocks used for flow cytometry-based neutralization and fusion assays was $2.5 \times 10^7$ pfu/ml. The titer of the RSV A2 stock used for attachment assay was $1.02 \times 10^8$ pfu/ml. HEp-2 cells were maintained in Eagle's minimal essential medium containing 10% fetal bovine serum (10% EMEM) and were supplemented with glutamine, penicillin and streptomycin.

Expression and Purification of Antibodies and Fab Fragments.

Antibodies were expressed by transient co-transfection of heavy and light chain plasmids into HEK293F cells in suspension at 37° C. for 4-5 days (see above, and also McLellan et al., Nat Struct Mol Biol 17, 248 (2010); McLellan et al., J Virol 84, 12236 (2010)). The cell supernatants were passed over Protein A agarose, and bound antibodies were washed with PBS and eluted with IgG elution buffer into 1/10th volume of 1 M Tris-HCl pH 8.0. Fabs were created by digesting the IgG with Lys-C or HRV3C protease (McLellan et al., Nature 480, 336 (2011)), and the Fab and Fc mixtures was passed back over Protein A agarose to remove Fc fragments. The Fabs that flowed through the column was further purified by size exclusion chromatography.

Screening of Prefusion-Stabilized RSV F Constructs.

Prefusion RSV F variants were derived from the RSV F (+) Fd construct (see Example 1), which consists of RSV F residues 1-513 with a C-terminal T4 fibritin trimerization motif (McLellan et al., Nature 480, 336 (2011)), thrombin site, 6×His-tag, and StreptagII. A 96-well microplate-formatted transient gene expression approach was used to achieve high-throughput expression of various RSV F proteins as described previously (Pancera et al., PLoS ONE 8, e55701 (2013)). Briefly, 24 hours prior to transfection HEK 293T cells were seeded in each well of a 96-well microplate at a density of $2.5 \times 10^5$ cells/ml in expression medium (high glucose DMEM supplemented with 10% ultra-low IgG fetal bovine serum and 1×-non-essential amino acids), and incubated at 37° C., 5% $CO_2$ for 20 h. Plasmid DNA and TrueFect-Max (United BioSystems, MD) were mixed and added to the growing cells, and the 96-well plate was incubated at 37° C., 5% $CO_2$. One day post transfection, enriched medium (high glucose DMEM plus 25% ultra-low IgG fetal bovine serum, 2× non-essential amino acids, 1× glutamine) was added to each well, and returned to incubator for continuous culture. On day five post transfection, the expressed RSV F protein in the supernatant was harvested and tested by ELISA for binding to D25 and motavizumab antibodies using $Ni^{2+}$-NTA microplates. After incubating the harvested supernatants at 4° C. for one week, the ELISAs were repeated.

Large-Scale Expression and Purification of RSV F Constructs.

Soluble postfusion RSV F was expressed and purified as described previously (McLellan, J Virol 85, 7788 (2011)). Prefusion variants were expressed by transient transfection in Expi293F cells using TrueFect-Max (United BioSystems, MD). The culture supernatants were harvested 5 days post transfection and centrifuged at 10,000 g to remove cell debris. The culture supernatants were sterile filtered prior to buffer exchange and concentrated using tangential flow filtration (van Reis, J Membrane Sci 159, 133 (1999)). RSV F glycoproteins were purified by immobilized nickel- and streptactin-affinity chromatography, and relevant fractions containing the RSV F variants were pooled, concentrated and subjected to size-exclusion chromatography (see Example 1). Affinity tags were removed by digestion with thrombin followed by size exclusion chromatography. Glycoproteins used in the non-human primate immunizations were tested for endotoxins using the limulus amebocyte lysate assay and if necessary, proteins were passed over an EndoTrap Red (BioVendor) column to remove endotoxins prior to immunizations. Endotoxin level was <5 EU/kg body weight/hr, as measured by the Endpoint Chromogenic Limulus Amebocyte Lysate (LAL) test kit (Lonza, Basel, Switzerland).

Stabilized RSV F Antigenic Characterization.

A fortéBio Octet Red384 instrument was used to measure binding kinetics of RSV F to antibodies that target antigenic site Ø (D25, AM22), site I (131-2a), site II (pavlizumab, motavizumab) and site IV (101F). All assays were performed with agitation set to 1,000 rpm in phosphate-buffered saline (PBS) supplemented with 1% bovine serum albumin (BSA) in order to minimize nonspecific interactions. The final volume for all solutions was 100 µl/well. Assays were performed at 30° C. in solid black 96-well plates (Geiger Bio-One). StrepMAB-Immo (35 µg/ml) in PBS buffer was used to load anti-mouse Fc probes for 300 s, which were then used to capture relevant RSV F variant proteins that contained a C-terminal Strep-tag. Typical capture levels for each loading step were between 0.7 and 1 nm, and variability within a row of eight tips did not exceed 0.1 nm for each of these steps. Biosensor tips were then equilibrated for 300 s in PBS+1% BSA prior to measuring association with antigen binding fragments (Fabs) in solution (0.002 µM to 1 µM) for 300 s; Fabs were then allowed to dissociate for 400 s-1200 s depending on the observed dissociation rate. Dissociation wells were used only once to prevent contamination. Parallel correction to subtract systematic baseline drift was carried out by subtracting the measurements recorded for a loaded sensor incubated in PBS+1% BSA. To remove nonspecific binding responses, a HIV-1 gp120 molecule with a C-terminal Strep-tag was loaded onto the anti-mouse Fc probes and incubated with RSV Fabs, and the nonspecific responses were subtracted from RSV F variant response data. Data analysis and curve fitting were carried out using Octet software, version 7.0. Experimental data were fitted with the binding equations describing a 1:1 interaction. Global analyses of the complete data sets assuming reversible binding (full dissociation) were carried out using nonlinear least-squares fitting allowing a single set of binding parameters to be obtained simultaneously for all concentrations used in each experiment.

Physical Stability of RSV F Variants.

To assess the physical stability of designed RSV F proteins under various stress conditions, the proteins were treated with a variety of pharmaceutically relevant stresses such as extreme pH, high temperature, low and high osmolality as well as repeated freeze/thaw cycles. The physical stability of treated RSV F proteins was evaluated by their degree of preservation of antigenic site Ø after treatment, a critical parameter assessed by binding of the site Ø-specific antibody D25.

In the pH treatment, RSV F protein was diluted to an initial concentration of 50 µg/ml, adjusted to pH 3.5 and pH 10 with appropriate buffers and incubated at room temperature for 60 minutes before neutralized back to pH7.5 and adjusted to 40 µg/ml. In the temperature treatment, RSV F protein at 40 µg/ml was incubated at 50° C., 70° C. and 90° C. for 60 minutes in PCR cyclers with heated lids to prevent evaporation. In the osmolality treatment, 100 µl of RSV F protein solutions (40 µg/me originally containing 350 mM NaCl were either diluted with 2.5 mM Tris buffer (pH 7.5) to an osmolality of 10 mM NaCl or adjusted with 4.5 M MgCl2 to a final concentration of 3.0 M. The protein solutions were incubated for 60 minutes at room temperature and then brought back to 350 mM NaCl by adding 5M NaCl or dilution with 2.5 mM Tris buffer, respectively, before concentration down to 100 The freeze/thaw treatment was carried out 10 times by repeated liquid nitrogen freezing and thawing at 37° C. Binding of antibody D25 to the treated RSV F proteins were measured with an Octet instrument with protocols described above. The degrees of physical stability were shown as the ratio of steady state D25-binding level before and after stress treatment.

Crystallization and X-Ray Data Collection of Prefusion-Stabilized RSV F Proteins.

Crystals of RSV F DS, Cav1, DSCav1, and DSCav1TriC were grown by the vapor diffusion method in hanging drops at 20° C. by mixing 1 µl of RSV F with 1 µl of reservoir solution (1.4 M K/Na tartrate, 0.1M CHES pH 9.5, 0.2 M LiSO$_4$). Crystals were directly frozen in liquid nitrogen. Crystals of RSV F Cav1 and DSCav1 were also grown by the vapor diffusion method in hanging drops at 20° C. by mixing 1 µl of RSV F with 0.5 µl of reservoir solution (1.7 M ammonium sulfate, 0.1 M citrate pH 5.5). Crystals were transferred to a solution of 3.2 M ammonium sulfate, 0.1 M citrate pH 5.5, and flash frozen in liquid nitrogen. All X-ray diffraction data were collected at a wavelength of 1.00 Å at the SER-CAT beamline ID-22.

Structure Determination, Refinement and Analysis of Prefusion-Stabilized RSV F.

X-ray diffraction data were integrated and scaled with the HKL2000 suite (Otwinowski and Minor, in Methods Enzymol. (Academic Press, 1997), vol. 276, pp. 307-326)), and molecular replacement solutions were obtained by PHASER (McCoy et al., Phaser crystallographic software. J. Appl. Crystallogr. 40, 658 (2007)) using the D25-bound RSV F structure (PDB ID: 4JHW, (see example 1)) as a search model. Manual model building was carried out using COOT (Emsley et al., Acta Crystallogr D Biol Crystallogr 66, 486 (2010)), and refinement was performed in PHENIX (Adams et al., Acta Crystallogr D Biol Crystallogr 66, 213 (2010)). Final data collection and refinement statistics are presented in FIG. 40. Superimpositions of RSV F structures were performed using residues 225-455 which showed high levels of structural similarity. Antigenic site Ø rmsd calculations were based on residues 61-71 and 194-219 which were within 10 Å of the D25 antibody in the RSV F-D25 complex structure.

Negative Staining Electron Microscopy Analysis.

Samples were adsorbed to freshly glow-discharged carbon-film grids, rinsed twice with buffer, and stained with freshly made 0.75% uranyl formate. Images were recorded on an FBI T20 microscope with a 2k×2k Eagle CCD camera at a pixel size of 1.5 Å. Image analysis and 2D averaging was performed with Bsoft (Heymann, J. Struct. Biol. 157, 3 (2007)) and EMAN (Ludtke et al., J. Struct. Biol. 128, 82 (1999)).

NHP Immunizations.

All animal experiments were reviewed and approved by the Animal Care and Use Committee of the Vaccine Research Center, NIAID, NIH, and all animals were housed and cared for in accordance with local, state, federal, and institute policies in an American Association for Accreditation of Laboratory Animal Care (AAALAC)-accredited facility at the NIH. *Macaca mulatta* animals of Indian origin weighing 8.76-14.68 kg were intramuscularly injected with immunogens at week 0 and week 4. Blood was collected every other week for up to 6 weeks.

RSV Neutralization Assays.

Sera were distributed as four-fold dilutions from 1:10 to 1:40960, mixed with an equal volume of recombinant mKate-RSV expressing prototypic F genes from strain A2 and the Katushka fluorescent protein, and incubated at 37° C. for one hour. Next, 50 µl of each serum dilution/virus mixture was added to HEp-2 cells that had been seeded at a density of $1.5 \times 10^4$ in 30 µl MEM (minimal essential medium) in each well of 384-well black optical bottom plates, and incubated for 20-22 hours before spectrophotometric analysis at Ex 588 nm and Em 635 nm (SpectraMax Paradigm, Molecular Devices, Sunnyvale, Calif. 94089). The IC50 for each sample was calculated by curve fitting and non-linear regression using GraphPad Prism (GraphPad Software Inc., San Diego Calif.). P values were determined by Student's T-test.

Sera Antigenicity Analysis.

A fortéBio Octet Red384 instrument was used to measure sera reactivity to RSV F variant proteins with agitation, temperature, 96-well plates, buffer and volumes identical to those used for kinetic measurements. RSV F DSCav1 and postfusion F were immobilized to amine coupling probes via probe activation in a EDC/NHS activation mixture for 300 s in 10 mM acetate pH 5. The probe reactivity was quenched using 10 mM ethanolamine pH 8.5. Typical capture levels were between 0.7 and 1 nm, and variability within a row of eight tips did not exceed 0.1 nm for each of these steps. Biosensor tips were then equilibrated for 300 s in PBS+1% BSA buffer prior to binding measurements. Sera were diluted to a 1/50 and 1/100 dilution in PBS+1% BSA and binding was assessed for 300s. Sera depletion was carried out by using 1 µg of DSCav1 or postfusion F proteins per 1 µl of animal sera. Parallel correction to subtract non-specific sera binding was carried out by subtracting binding levels of an unloaded probe incubated with the sera. Site-specific antigenicity was assessed by incubating the RSV F variant-loaded probes with 1 or 2 µM D25 Fab for site Ø assessment and motavizumab Fab for site II assessment or both antibodies to assess the remaining non-site Ø/II reactivity.

Example 10

Single Chain RSV F Proteins Stabilized in a Prefusion Conformation

This example illustrates additional recombinant RSV F proteins that lack the native furin cleavage sites, such that the F protein protomer is formed as a single polypeptide chain, instead of a $F_2/F_1$ heterodimer. Schematic diagrams illustrating design of the additional prefusion-stabilized single-chain RSV F proteins are provided in FIGS. 43 and 44.

FIGS. 43-45 illustrate the design of a series of single chain constructs, including single-chain RSV F construct no. 9 (scF no. 9; BZGJ9 DSCav1; SEQ ID NO: 669). Variables for the single chain constructs include the linker size, the F1 and F2 end points and the mechanism used to induce trimerization of the single chain construct. Additionally, several strategies can be employed to stabilize the single chain constructs in a prefusion conformation, including use of the strategies described herein. The indicated single chain constructs were expressed in cells and characterized by size exclusion chromatography (FIG. 46) and binding to RSV F specific antibodies (FIG. 47).

To further characterize the RSV F construct no. 9 (scF no. 9; BZGJ9 DSCav1; SEQ ID NO: 669), the three dimensional structure of this protein was solved by X-ray crystallography (see FIGS. 48-51). Cubic crystals were grown using the vapor diffusion method in a reservoir solution of 1.19 M $Li_2SO_4$, 3.33% PEG 400, 0.12 M $MgSO_4$, 0.1 M NaOAc pH 5.5. Crystals grew to ~120 µm before they were flash-frozen in a reservoir solution containing 2 M lithium sulfate. The diffraction data was collected to a resolution of 3.2 Å with an intensity over error of 2.84. The crystal structure illustrated the location of the GS linker in construct No. 9 (FIGS. 49 and 50), was used to predict the location of other linker sizes (FIG. 51), and as the basis of the design of additional single chain constructs BZGJ9-1 through 9-10 (see FIG. 55). Single-chain construct codon-optimized genes with a C-terminal T4 fibritin trimerization motif, thrombin site, 6×His-tag, and StreptagII was synthesized and subcloned into a mammalian expression vector derived from pLEXm. Plasmids expressing RSV F(+) Fd, were transfected into HEK293 GnTI−/− Cells in suspension. After 4-5 days, the cell supernatant was harvested, centrifuged, filtered and concentrated. The protein was initially purified via Ni2+-NTA resin (Qiagen, Valencia, Calif.) using an elution buffer consisting of 20 mM Tris-HCl pH 7.5, 200 mM NaCl, and 250 mM imidazole pH 8.0. The complex was then concentrated and further purified over StrepTactin resin as per the manufacturer's instructions (Novagen, Darmstadt, Germany). After an overnight incubation with thrombin protease (Novagen) to remove the His and Strep tags, an excess of D25 Fab was added to the complex, which was then purified on a Superdex-200 gel filtration column (GE Healthcare) with a running buffer of 2 mM Tris-HCl pH 7.5, 350 mM NaCl, and 0.02% NaN3 or phosphate buffered saline (PBS) pH7.4. Single-chain-Ferritin single gene products were expressed and purified in a similar manner.

Several single chain constructs were selected for immunogenicity testing in animal models (FIG. 53). BZGJ9 DS-Cav1, BZGJ9, BZGJ11 DS-Cav1 (monomer), BZGJ10 (monomer and trimer fractions), BZGJ8 (monomer), BZGJ4 DS-Cav1 and BZGJ11 DS-Cav1-Lumazine synthase (60mer oligomer) were all tested for immunogenicity in groups of 10 CB6F15 mice by injecting 10 ug of protein in the presence of 50 ug Poly I:C at week 0 and week 3. Sera from week 5 was tested for immunogenicity. Control groups of RSV F subtype A DS-Cav1 and Postfusion protein were also tested and immunized in a similar manner.

To assess neutralization against RSV subtype A and Subtype B, sera from immunized animals were distributed as four-fold dilutions from 1:10 to 1:40960, mixed with an equal volume of recombinant mKate-RSV expressing prototypic F genes from subtype A (strain A2) or subtype B (strain 18537) and the Katushka fluorescent protein, and incubated at 37° C. for 1 h. Next, 50 µl of each serum dilution/virus mixture was added to HEp-2 cells that had been seeded at a density of 1.5×104 in 30 µl MEM (minimal essential medium) in each well of 384-well black optical bottom plates, and incubated for 20-22 h before spectrophotometric analysis at 588 nm excitation and 635 nm emission (SpectraMax Paradigm, Molecular Devices, CA). The IC50 for each sample was calculated by curve fitting and non-linear regression using GraphPad Prism (GraphPad Software Inc., CA). P-values were determined by Student's t-test.

The neutralization results show that all tested single chain constructs are immunogenic.

The single chain constructs were linked to ferritin to produce ferritin nanoparticles including the scF antigens (FIG. 56). Briefly, the C-terminus of the F1 polypeptide included in the scF protein was linked to ferritin, and the recombinant protein was expressed in cells to produce scF-ferritin nanoparticles. One example is the "BZGJ9-DS-Cav1-LongLink-Ferritin" protein (SEQ ID NO: 1429), which includes a recombinant RSV F single chain protein including a GS linker between RSV F positions 105 and 145 and a ferritin subunit linked to position 513 of the RSV F protein by a heterologous peptide linker generated by linking the C-terminus of the F1 polypeptide in scF no. 9 to a ferritin subunit. The scF-ferritin nanoparticles were expressed, purified, and characterized for temperature, pH, and osmolarity stability (FIG. 57). Additionally, the ferritin nanoparticles were administered to animals to demonstrate that they are immunogenic (FIG. 58). The three constructs tested were RSV F DSCav1 (SEQ ID NO: 371), BZGJ9-DS-Cav1-LongLink-Ferritin (SEQ ID NO: 1429), and scF no. 9 (also termed BZGJ9 DS-Cav1, SEQ ID NO: 669). These are the same immunogenicity/neutralization as described above.

Several single chains sequences are provided in the SEQ ID NOs listed in Table 19, as well as an indication of design approach.

TABLE 19

Exemplary Single Chain RSV F proteins

| Name | Concept | Background | | Mutations | SEQ ID NO |
|---|---|---|---|---|---|
| Non-cleavable Foldon | | | | | |
| BZGJ9-1 | SC BZGJ9-DS-Cav1 w/IL | | | G linker between residue 105 to 145 | 698 |
| BZGJ9-2 | SC BZGJ9-DS-Cav1 w/IL | | | GG linker between residue 105 to 145 | 699 |
| BZGJ9-3 | SC BZGJ9-DS-Cav1 w/IL | | | GQG linker between residue 105 to 145 | 700 |
| BZGJ9-4 | SC BZGJ9-DS-Cav1 w/IL | | | GGSG(Seq_1443) linker between residue 105 to 145 | 701 |
| BZGJ9-5 | SC BZGJ9-DS-Cav1 w/IL | | | GGSG(Seq_1443) linker between residue 105 to 145 | 702 |
| BZGJ9-6 | SC BZGJ9-DS-Cav1 w/IL | | | GGSG(Seq_1443) linker between residue 105 to 145 | 703 |
| BZGJ9-7 | SC BZGJ9-DS-Cav1 w/IL | | | GGSGGS(Seq_1444) linker between residue 105 to 145 | 704 |
| BZGJ9-8 | SC BZGJ9-DS-Cav1 w/IL | | | GGSGGSG(Seq_1445) linker between residue 105 to 145 | 705 |
| BZGJ9-9 | SC BZGJ9-DS-Cav1 w/IL | | | Fusion of residue 103 to 145 | 706 |
| BZGJ9-10 | SC BZGJ9-DS-Cav1 w/IL | | | GS linker between residue 103 to 145 | 707 |
| Cleavable Foldon | | | | | |
| scRSVF9aCCextxFd | Inter-DS | BZGJ9a (SeqID 669 w/o DSCav1 mut.) | xFd | 512CChnvnagkstt (Res. 513-513 of SEQ ID NO: 844) | 708 |
| scRSVF9aC485C494xFd | Inter-DS | BZGJ9a | xFd | 485C, 494C | 709 |
| scRSVF9aC519C520extxFd | Inter-DS | BZGJ9a | xFd | 512LLhnvnaCCstt (Res. of 475-486 SEQ ID NO: 71-) | 710 |
| scRSVF9aC99C362xFd | Inter-DS | BZGJ9a | xFd | 99C, 362C | 711 |
| scRSVF9aC99C361xFd | Inter-DS | BZGJ9a | xFd | 99C, 361C | 712 |
| scRSVF9aC153C461xFd | Inter-DS | BZGJ9a | xFd | 153C, 461C | 713 |
| scRSVF9aC102C359xFd | Inter-DS | BZGJ9a | xFd | 102C, 359C | 714 |

TABLE 19-continued

Exemplary Single Chain RSV F proteins

| Name | Concept | Back-ground | | Mutations | SEQ ID NO |
|---|---|---|---|---|---|
| scRSV F 9axFd | xFd | BZGJ9a | xFd | 512LLSAI | 715 |
| scRSV F 9aextxFd | xFd | BZGJ9a | xFd | 512LLhnvnagkstt (Res. 475-486 of SEQ ID NO: 716) | 716 |
| Ferritin Particles - No Foldon | | | | | |
| OpFer1 | ES of RSV F | BZGJ9a | Fer | S190V | 717 |
| OpFer2 | ES of RSV F | BZGJ9a | Fer | K226L | 718 |
| OpFer3 | ES of RSV F | BZGJ9a | Fer | T58I, A298M | 719 |
| OpFer4 | ES of RSV F | BZGJ9a | Fer | S190V, K226L | 720 |
| OpFer5 | ES of RSV F | BZGJ9a | Fer | S190V, T58I, A298M | 721 |
| OpFer6 | ES of RSV F | BZGJ9a | Fer | K226L, T58I, A298M | 722 |
| OpFer7 | ES of RSV F | BZGJ9a | Fer | T58I, A298M, S190V, K226L | 723 |
| OpFer8 | ES of RSV F | BZGJ9a | Fer | Cav1 | 724 |
| OpFer9 | ES of RSV F | BZGJ9a | Fer | NoMutationsSC9a | 725 |
| OpFer10 | ES of RSV F | BZGJ9a | Fer | S190V with optimized coil coil - 8aa linker | 726 |
| OpFer11 | ES of RSV F | BZGJ9a | Fer | S190V With CC and optimized coiled coil - 8aa linker | 727 |
| OpFer12 | ES of RSV F | BZGJ9a | Fer | S190V FIRKSDELLSAIGGYIPS APSGSG-Fer (Res. 495-518 of SEQ ID NO: 728) | 728 |
| OpFer13 | ES of RSV F | BZGJ9a | Fer | S190V SC-Foldon-8aa-Fer | 729 |
| OpFer14 | ES of RSV F | BZGJ9a | Fer | S190V optimized leader | 730 |
| Non-cleavable Foldon | | | | | |
| OpFd1 | ES of RSV F | BZGJ9a | Fd | S190V | 731 |
| OpFd2 | ES of RSV F | BZGJ9a | Fd | K226L | 732 |
| OpFd3 | ES of RSV F | BZGJ9a | Fd | T58I, A298M | 733 |
| OpFd4 | ES of RSV F | BZGJ9a | Fd | S190V, K226L | 734 |
| OpFd5 | ES of RSV F | BZGJ9a | Fd | S190V, T58I, A298M | 735 |
| OpFd6 | ES of RSV F | BZGJ9a | Fd | K226L, T58I, A298M | 736 |
| OpFd7 | ES of RSV F | BZGJ9a | Fd | T58I, A298M, S190V, K226L | 737 |
| OpFd8 | ES of RSV F | BZGJ9a | Fd | S190F, V207L | 738 |
| OpFd9 | ES of RSV F | BZGJ9a | Fd | NoMutationsSC9a | 739 |
| OpFd10 | ES of RSV F | BZGJ9a | Fd | S190V with optimized coil coil | 740 |

TABLE 19-continued

Exemplary Single Chain RSV F proteins

| Name | Concept | Background | | Mutations | SEQ ID NO |
|---|---|---|---|---|---|
| OpFd11 | ES of RSV F | BZGJ9a | Fd | S190V With CC and optimized coiled coil | 741 |
| OpFd14 | ES of RSV F | BZGJ9a | Fd | S190V optimized leader | 742 |
| OpFd14 | ES of RSV F | BZGJ9a | Fd | S190V optimized leader | 743 |
| Cleavable Foldon | | | | | |
| scRSVF9a 74C218C xFd | Inter-DS | BZGJ9a | xFd | 74C, 218C | 744 |
| scRSVF9a 146C460C xFd | Inter-DS | BZGJ9a | xFd | 146C, 460C | 745 |
| scRSVF9a 149C458C xFd | Inter-DS | BZGJ9a | xFd | 149C, 458C | 746 |
| scRSVF9a 374C454C xFd | Inter-DS | BZGJ9a | xFd | 374C, 454C | 747 |
| scRSVF 74C218C xFd | Inter-DS | SEQ_669 (BZGJ9 DSCav1) | xFd | 74C, 218C | 748 |
| scRSVF 146C460C xFd | Inter-DS | BZGJ9 DSCav1 | xFd | 146C, 460C | 749 |
| scRSVF 149C458C xFd | Inter-DS | BZGJ9 DSCav1 | xFd | 149C, 458C | 750 |
| scRSVF 374C454C xFd | Inter-DS | BZGJ9 DSCav1 | xFd | 374C, 454C | 751 |
| scRSVF9 C485C494xFd | Inter-DS | BZGJ9 DSCav1 | xFd | 485C, 494C | 752 |
| scRSVF9 C519C520extxFd | Inter-DS | BZGJ9 DSCav1 | xFd | 519C, 520C | 753 |
| scRSVF9 C99C362xFd | Inter-DS | BZGJ9 DSCav1 | xFd | 99C, 362C | 754 |
| scRSVF9 C99C361xFd | Inter-DS | BZGJ9 DSCav1 | xFd | 99C, 361C | 755 |
| scRSVF9 C153C461xFd | Inter-DS | BZGJ9 DSCav1 | xFd | 153C, 461C | 756 |
| scRSVF9 C102C359xFd | Inter-DS | BZGJ9 DSCav1 | xFd | 102C, 359C | 757 |
| Non-Cleavable Foldon | | | | | |
| BZGJ9pi I217W | Inter-DS | BZGJ9 DSCav1 | Fd | I217W | 758 |
| BZGJ9pi I221W | Inter-DS | BZGJ9 DSCav1 | Fd | I221W | 759 |
| BZGJ9pi D486F | Inter-DS | BZGJ9 DSCav1 | Fd | H486F | 760 |
| BZGJ9pi T400F | Inter-DS | BZGJ9 DSCav1 | Fd | T400F | 761 |
| BZGJ9pi V278F | Inter-DS | BZGJ9 DSCav1 | Fd | V278F | 762 |
| BZGJ9pi Q224D,L78K | Inter-DS | BZGJ9 DSCav1 | Fd | Q224D, L78K | 763 |

TABLE 19-continued

Exemplary Single Chain RSV F proteins

| Name | Concept | Background | | Mutations | SEQ ID NO |
|---|---|---|---|---|---|
| BZGJ9pi I217W, I221W | Inter-DS | BZGJ9 DSCav1 | Fd | I217W, I221W | 764 |
| BZGJ9pi I217W, I221W, L78F | Inter-DS | BZGJ9 DSCav1 | Fd | I217W, I221W, L78F | 765 |
| GSJscINT_1 | SC RSV F | DSCAV1 | Fd | F2 linked to full fusion peptide by (Gly)n linker | 766 |
| GSJscINT_2 | SC RSV F | DSCAV2 | Fd | F2 linked to full fusion peptide by (Gly)n linker | 767 |
| GSJscINT_3 | SC RSV F | DSCAV3 | Fd | F2 linked to full fusion peptide by (Gly)n linker | 768 |
| GSJscINT_2 F488W | SC RSV F | DSCAV4 | Fd | F2 linked to full fusion peptide by (Gly)n linker | 769 |
| GSJscINT_1 Q354A | SC RSV F | DSCAV5 | Fd | F2 linked to full fusion peptide by (Gly)n linker | 770 |
| GSJscINT_MBE | SC RSV F | DSCAV6 | Fd | F2 linked to full fusion peptide by (Gly)n linker | 771 |
| GSJscINT_2 F488Wsh | SC RSV F | DSCAV7 | Fd | F2 linked to full fusion peptide by (Gly)n linker | 772 |
| GSJscINT_1 F488Wsh | SC RSV F | DSCAV8 | Fd | F2 linked to full fusion peptide by (Gly)n linker | 773 |
| BZGJ9-11 | SC BZGJ9-DS-Cav1 w/IL | | Fd | GS linker between 102 to 145 | 774 |
| BZGJ9-12 | SC BZGJ9-DS-Cav1 w/IL | | Fd | GS linker between 101 to 145 | 775 |
| BZGJ9-13 | SC BZGJ9-DS-Cav1 w/IL | | Fd | GS linker between 100 to 145 | 776 |
| BZGJ9-14 | SC BZGJ9-DS-Cav1 w/IL | | Fd | GS linker between 99 to 145 | 777 |
| BZGJ9-15 | SC BZGJ9-DS-Cav1 w/IL | | Fd | GS linker between 98 to 145 | 778 |
| BZGJ9-16 | SC BZGJ9-DS-Cav1 w/IL | | Fd | GS linker between 97 to 145 | 779 |
| BZGJ9-17 | SC BZGJ9-DS-Cav1 w/IL | | Fd | GGSG (SEQ ID NO: 1443) linker between 103 to 145 | 780 |
| BZGJ9-18 | SC BZGJ9-DS-Cav1 w/IL | | Fd | GGSGG (SEQ ID NO: 1448) linker between 103 to 145 | 781 |
| BZGJ9-19 | SC BZGJ9-DS-Cav1 w/IL | | Fd | GGSGGSG (SEQ ID NO: 1445) linker between 103 to 145 | 782 |
| BZGJ9-20 | SC BZGJ9-DS-Cav1 w/IL | | Fd | GGSGN (Res. 104-108 of SEQ ID NO: 783) linker between 103 to 145 | 783 |

TABLE 19-continued

Exemplary Single Chain RSV F proteins

| Name | Concept | Background | Mutations | SEQ ID NO |
|---|---|---|---|---|
| BZGJ9-21 | SC BZGJ9-DS-Cav1 w/IL | Fd | N linker between 102 to 145 | 784 |
| BZGJ9-22 | SC BZGJ9-DS-Cav1 w/IL | Fd | ISSTSATGS (Res. 97-105 of SEQ ID NO: 785) linker between 96 to 145 | 785 |
| BZGJ9-23 | SC BZGJ9-DS-Cav1 w/IL | Fd | VTSTSATGS (Res. 97-105 of SEQ ID NO: 786) linker between 96 to 145 | 786 |
| BZGJ9-24 | SC BZGJ9-DS-Cav1 w/IL | Fd | NSALSATGS (Res. 97-105 of SEQ ID NO: 787) linker between 96 to 145 | 787 |
| BZGJ9-25 | SC BZGJ9-DS-Cav1 w/IL | Fd | ISSTTSTGS (Res. 97-105 of SEQ ID NO: 788) linker between 96 to 145 | 788 |
| BZGJ9-26 | SC BZGJ9-DS-Cav1 w/IL | Fd | VTSTTSTGS (Res. 97-105 of SEQ ID NO: 789) linker between 96 to 145 | 789 |
| BZGJ9-27 | SC BZGJ9-DS-Cav1 w/IL | Fd | NSALSSTGS (Res. 97-105 of SEQ ID NO: 790) linker between 96 to 145 | 790 |
| BZGJ9-28 | SC BZGJ9-DS-Cav1 w/IL | Fd | ISSTSATVGGS (Res. 97-107 of SEQ ID NO: 791) linker between 96 to 145 | 791 |
| BZGJ9-29 | SC BZGJ9-DS-Cav1 w/IL | Fd | VTSTSATTGGS (Res. 97-107 of SEQ ID NO: 792) linker between 96 to 145 | 792 |
| BZGJ9-30 | SC BZGJ9-DS-Cav1 w/IL | Fd | NSALSATGGS (Res. 97-106 of SEQ ID NO: 793) linker between 96 to 145 | 793 |
| BZGJ9-31 | SC BZGJ9-DS-Cav1 w/IL | Fd | LISSTTSTVGGS (Res. 97-108 of SEQ ID NO: 794) linker between 96 to 145 | 794 |
| BZGJ9-32 | SC BZGJ9-DS-Cav1 w/IL | Fd | VTSTTSTTGGS (Res. 97-107 of SEQ ID NO: 795) linker between 96 to 145 | 795 |
| BZGJ9-33 | SC BZGJ9-DS-Cav1 w/IL | Fd | NSALSSTGGS (Res. 97-106 of SEQ ID NO: 796) linker between 96 to 145 | 796 |
| Lumazine Synthase Particles | | | | |
| BZGJ10-DSCav1-LS | Monomer RSV F SC on LS | LS | SEKS Furin site I and SEKSGS Furin site II (Res. 131-134, 131-136 of SEQ ID NO: 797) | 797 |

TABLE 19-continued

Exemplary Single Chain RSV F proteins

| Name | Concept | Background | Mutations | SEQ ID NO |
|---|---|---|---|---|
| BZGJ10-DSCav1 DEF-LS | Monomer RSV F SC on LS | LS | SEKS Furin site I and SEKSGS Furin site II (Res. 131-134, 131-136 of SEQ ID NO: 797) | 798 |
| BZGJ11-DSCav1-LS | Monomer RSV F SC on LS | LS | SEKS Furin site I and SEKSGS Furin site II (Res. 131-134, 131-136 of SEQ ID NO: 797) | 799 |
| BZGJ11-DSCav1-SS-LS | Monomer RSV F SC on LS | LS | SEKS Furin site I and SEKSGS Furin site II (Res. 131-134, 131-136 of SEQ ID NO: 797) | 800 |
| Non-cleavable Foldon, with Pep27 | | | | |
| A2-PP1 | SC w/o furin sites to maintain pep27 | Fd | SEKS Furin site I and SEKSGS Furin site II (Res. 131-134, 131-136 of SEQ ID NO: 797) | 801 |
| B18537-PP1 | SC w/o furin sites to maintain pep27 | Fd | SEKS Furin site I and SEKSGS Furin site II (Res. 131-134, 131-136 of SEQ ID NO: 797) | 802 |
| A2-DS-Cav1-PP1 | SC w/o furin sites to maintain pep27 | Fd | SEKS Furin site I and SEKSGS Furin site II (Res. 131-134, 131-136 of SEQ ID NO: 797) | 803 |
| B18537 DS-Cav1-PP1 | SC w/o furin sites to maintain pep27 | Fd | SEKS Furin site I and SEKSGS Furin site II (Res. 131-134, 131-136 of SEQ ID NO: 797) | 804 |
| A2-DS-Cav1-PP1-dFold | SC w/o furin sites to maintain pep27 | Fd | SEKS Furin site I and SEKSGS Furin site II (Res. 131-134, 131-136 of SEQ ID NO: 797) | 805 |
| B18537 DS-Cav1-PP1-dFold | SC w/o furin sites to maintain pep27 | Fd | SEKS Furin site I and SEKSGS Furin site II (Res. 131-134, 131-136 of SEQ ID NO: 797) | 806 |
| A2-DS-Cav1-PP1-GCN4 | SC w/o furin sites to maintain pep27 | Fd | SEKS Furin site I and SEKSGS Furin site II (Res. 131-134, 131-136 of SEQ ID NO: 797) | 807 |
| B18537 DS-Cav1-PP1-GCN4 | SC w/o furin sites to maintain pep27 | Fd | SEKS Furin site I and SEKSGS Furin site II (Res. 131-134, 131-136 of SEQ ID NO: 797) | 808 |
| BZGJ9-dscav1 N155Q | SC BZGJ9-DS-Cav1 w/IL | Fd | Removal of introduced glycan site on BZGJ9-DS-Cav1 (SEQ ID: 669 | 809 |

TABLE 19-continued

Exemplary Single Chain RSV F proteins

| Name | Concept | Background | Mutations | SEQ ID NO |
|---|---|---|---|---|
| | | | located in the linker region on Asn 105 | |
| BZGJ9-DS-Cav1-FerritinHis | Add Histidines to Ferr to improve expression and purification | Fd | Introduction of six His residues to the Ferritin molecule to enable purification of RSV F molecules in the Ferritin context without using His-tag or Strep-Tag sequences. | 810 |

Additional constructs

| Name | Concept | Background | Mutations | SEQ ID NO |
|---|---|---|---|---|
| B18537-BZGJ9-9 | B18537 strain | Fd | Single chain RSV F subtype B (strain B18537) with direct fusion of residue 103 to 145 | 811 |
| B18537-BZGJ9-10 | B18537 strain | Fd | Single chain RSV F subtype B (strain B18537) with GS linker between residue 103 to 145 | 812 |
| B1-BZGJ9-9 | B1 strain | Fd | Single chain RSV F subtype B (strain B1) with direct fusion of residue 103 to 145 | 813 |
| B1-BZGJ9-10 | B1 strain | Fd | Single chain RSV F subtype B (strain B) with GS linker between residue 103 to 145 | 814 |
| BZGJ9ext-9 | | xFd | Single chain RSV F DS-Cav1 (BZGJ9 #669) with direct fusion of residue 103 to 145 and an elongation of the C-terminus adding residues hnvnagkstt (residues 473-482 of SEQ ID NO: 815) after L513 and prior to the Thrombin-His-Strep tags. | 815 |
| BZGJ9ext-10 | | xFd | Single chain RSV F DS-Cav1 (BZGJ9 #669) with GS linker between residue 103 to 145 and an elongation of the C-terminus adding residues hnvnagkstt (residues 473-482 of SEQ ID NO: 815) after L513 and prior to the Thrombin-His-Strep tags. | 816 |

TABLE 19-continued

Exemplary Single Chain RSV F proteins

| Name | Concept | Background | Mutations | SEQ ID NO |
|---|---|---|---|---|
| B18537-BZGJ9ext-9 | B18537 strain | xFd | Single chain RSV F DS-Cav1 (subtype B (strain B18537) with direct fusion of residue 103 to 145 and an elongation of the C-terminus adding residues hnvnagkstt (residues 473-482 of SEQ ID NO: 815) after L513 and prior to the Thrombin-His-Strep tags. | 817 |
| B18537-BZGJ9ext-10 | B18537 strain | xFd | Single chain RSV F DS-Cav1 (subtype B (strain B18537) with GS linker between residue 103 to 145 and an elongation of the C-terminus adding residues hnvnagkstt (residues 473-482 of SEQ ID NO: 815) after L513 and prior to the Thrombin-His-Strep tags. | 818 |
| B1-BZGJ9ext-9 | B1 strain | xFd | Single chain RSV F DS-Cav1 (subtype B (strain B1) with direct fusion of residue 103 to 145 and an elongation of the C-terminus adding residues hnvnagkstt (residues 473-482 of SEQ ID NO: 815) after L513 and prior to the Thrombin-His-Strep tags. | 819 |
| B1-BZGJ9ext-10 | B1 strain | xFd | Single chain RSV F DS-Cav1 (subtype B (strain B1) with GS linker between residue 103 to 145 and an elongation of the C-terminus adding residues hnvnagkstt (residues 473-482 of SEQ ID NO: 815) after L513 and prior to the Thrombin-His-Strep tags. | 820 |
| BZGJ9extxFd-9 | | | Single chain RSV F DS-Cav1 (BZGJ9 #669) with direct fusion of residue 103 to 145 and an elongation of the C-terminus adding residues hnvnagkstt (residues 473-482 of SEQ ID NO: 815) | 821 |

TABLE 19-continued

Exemplary Single Chain RSV F proteins

| Name | Concept | Background | Mutations | SEQ ID NO |
|---|---|---|---|---|
| | | | after L513 and prior to the cleavable Foldon and Thrombin-His-Strep tags. | |
| BZGJ9extxFd-10 | | | Single chain RSV F DS-Cav1 (BZGJ9 #669) with GS linker between residue 103 to 145 and an elongation of the C-terminus adding residues hnvnagkstt (residues 473-482 of SEQ ID NO: 815) after L513 and prior to the cleavable Foldon and Thrombin-His-Strep tags. | 822 |
| B18537-BZGJ9extxFd-9 | B18537 strain | | Single chain RSV F DS-Cav1 (subtype B (strain B18537) with direct fusion of residue 103 to 145 and an elongation of the C-terminus adding residues hnvnagkstt (residues 473-482 of SEQ ID NO: 815) after L513 and prior to the cleavable Foldon and Thrombin-His-Strep tags. | 823 |
| B18537-BZGJ9extxFd-10 | B18537 strain | | Single chain RSV F DS-Cav1(subtype B (strain B18537) with GS linker between residue 103 to 145 and an elongation of the C-terminus adding residues hnvnagkstt (residues 473-482 of SEQ ID NO: 815) after L513 and prior to the cleavable Foldon and Thrombin-His-Strep tags. | 824 |
| B1-BZGJ9extxFd-9 | B1 strain | | Single chain RSV F DS-Cav1 (subtype B (strain B1) with direct fusion of residue 103 to 145 and an elongation of the C-terminus adding residues hnvnagkstt (residues 473-482 of SEQ ID NO: 815) after L513 and prior to the cleavable Foldon and Thrombin-His-Strep tags. | 825 |

TABLE 19-continued

Exemplary Single Chain RSV F proteins

| Name | Concept | Back-ground | Mutations | SEQ ID NO |
|---|---|---|---|---|
| B1-BZGJ9extxFd-10 | B1 strain | | Single chain RSV F DS-Cav1 (subtype B (strain B1) with GS linker between residue 103 to 145 and an elongation of the C-terminus adding residues hnvnagkstt (residues 473-482 of SEQ ID NO: 815) after L513 and prior to the Thrombin-His-Strep tags. (residues 473-482 | 826 |
| BZGJ9-CS1 | | | Single chain RSV F with linker MTSVLHRFDTDAF (Res. 72-84 of SEQ ID NO: 1474) between 96 and 150 | 1474 |
| BZGJ9-CS2 | | | Single chain RSV F with linker MTSVLWFGDTDAFA (Res. 72-84 of SEQ ID NO: 1475) between 96 and 150 | 1475 |
| BZGJ9-10-GSJCCtail5xFd | | xFd | Single chain RSV F based on sequence #707 with C-terminalsequence CChnvnagksttnGGLVP (Res. 512-532 of SEQ ID NO: 834) RGS encoding disulphide bonds and cleavable foldon | 1476 |
| BZGJ9-10-GSJCCtail6xFd | | xFd | Single chain RSV F based on sequence #707 with C-terminal sequence LLhnvnaCCsttnGGLVP (Res. 512-532 of SEQ ID NO: 845) RGS encoding disulphide bonds and cleavable foldon | 1477 |
| BZGJ9-10-GSJCCtail9xFd | | xFd | Single chain RSV F based on sequence #707 with C-terminal sequence CChnvnaCCsttnGGLVP RGS encoding (Res. 512-532 of SEQ ID NO: 851) disulphide bonds and cleavable foldon | 1478 |
| BZGJ9-9-DS-Cav1-Ferritin | | | RSV F single chain BZGJ9-9 (#706) with Fusion of residue 103 to 145in the Ferritin context | 827 |

TABLE 19-continued

Exemplary Single Chain RSV F proteins

| Name | Concept | Background | Mutations | SEQ ID NO |
|---|---|---|---|---|
| BZGJ9-10-DS-Cav1-Ferritin | | | RSV F single chain BZGJ9-10 (#707) GS linker between residue 103 to 145 | 828 |
| BZGJ9-DS-Cav1-LongLink-Ferritin | | | RSV F single chain BZGJ9 (#669) in the Ferritin context with a long linker from the RSV F C-terminus to the Ferritin N-terminus | 1429 |
| BZGJ9-9-DS-Cav1-LongLink-Ferritin | | | RSV F single chain BZGJ9-9 (#706) with Fusion of residue 103 to 145 in the Ferritin context with a long linker from RSV C-terminus to Ferritin N-terminus | 1430 |
| BZGJ9-10-DS-Cav1-LongLink-Ferritin | | | RSV F single chain BZGJ9-10 (#707) GS linker between residue 103 to 145 in the Ferritin context with a long linker from RSV C-terminus to Ferritin N-terminus | 1431 |
| BZGJ9-DS-Cav1-LongLinkFerritinHis | Add Histidines to Ferr to improve expression and purification | | RSV F single chain BZGJ9 (#669) in the Ferritin context with a long linker from the RSV F C-terminus to the Ferritin N-terminus with added histidines to the Ferritin molecule to facilitate purification of Ferritin nanoparticles without the use of His or Strep-tags. | 1432 |
| BZGJ9-IG1 | SC BZGJ9-DS-Cav1 w/IL | | ARLLGSGSG (Res. 97-105 of SEQ ID NO: 1433) linker from 96 to 147 | 1433 |
| BZGJ9-IG2 | SC BZGJ9-DS-Cav1 w/IL | | ARLLGGSG (Res. 97-105 of SEQ ID NO: 1434) linker from 96 to 147 | 1434 |
| BZGJ9-IG3 | SC BZGJ9-DS-Cav1 w/IL | | ARLLGGSG (Res. 97-105 of SEQ ID NO: 1435) linker from 96 to 148 | 1435 |

TABLE 19-continued

Exemplary Single Chain RSV F proteins

| Name | Concept | Background | Mutations | SEQ ID NO |
|---|---|---|---|---|
| BZGJ9-IG4 | SC BZGJ9-DS-Cav1 w/IL | | LARLLGSG (Res. 97-105 of SEQ ID NO: 1436) linker from 96 to 147 | 1436 |
| BZGJ9-IG5 | SC BZGJ9-DS-Cav1 w/IL | | mqstGGSG (Res. 97-105 of SEQ ID NO: 1437) linker from 96 to 147 | 1437 |
| BZGJ9-IG6 | SC BZGJ9-DS-Cav1 w/IL | | aqstGGSG (Res. 97-105 of SEQ ID NO: 1438) linker from 96 to 147 | 1438 |
| B18537-BZGJ9-9-LongLink-Ferritin | B18537 strain | | RSV F single chain BZGJ9-9 (#811) with Fusion of residue 103 to 145 in the Ferritin context with a long linker from RSV C-terminus to Ferritin N-terminus | 1439 |
| B18537-BZGJ9-10-LongLink-Ferritin | B18537 strain | | RSV F single chain BZGJ9-10 (#812) GS linker between residue 103 to 145 in the Ferritin context with a long linker from RSV C-terminus to Ferritin N-terminus | 1440 |
| B1-BZGJ9-9-LongLink-Ferritin | B1 strain | | RSV F single chain BZGJ9-9 (#813) with Fusion of residue 103 to 145 in the Ferritin context with a long linker from RSV C-terminus to Ferritin N-terminus | 1441 |
| B1-BZGJ9-10-LongLink-Ferritin | B1 strain | | RSV F single chain BZGJ9-10 (#814) GS linker between residue 103 to 145 in the Ferritin context with a long linker from RSV C-terminus to Ferritin N-terminus | 1442 |

The yield of protein was calculated for several of the recombinant F proteins, and is shown below in Table 27.

TABLE 27

Yield of recombinant RSV F protein expression

| Construct Name | Yield (mg/L) | SEQ ID NO |
|---|---|---|
| scRSVF9aCCextxFd | 12.7 | 708 |
| scRSVF9aC485C494xFd | 4.1 | 709 |
| scRSVF9aC419C420extxFd | 11.4 | 710 |
| scRSVF9aC99C362xFd | 2.2 | 711 |
| scRSV F 9axFd | 15.7 | 715 |
| scRSV F 9aextxFd | 29.6 | 716 |

TABLE 27-continued

Yield of recombinant RSV F protein expression

| Construct Name | Yield (mg/L) | SEQ ID NO |
|---|---|---|
| GSJscINT_1 | 0.84 | 766 |
| GSJscINT_3 | 0.9 | 768 |

Example 11

The Structure of an RSV F Protein from the B18537 Strain with the DSCav1 Mutations This examples illustrated the similarity of the RSV protein with the stabilizing DSCav1 substitutions across RSV subtypes. The DSCav1 substitutions were introduced into the RSV F protein from the B18537 strain. And the three dimensional structure of the resulting recombinant protein, including a C-terminal Foldon domain, was solved using methods similar to those described above. As shown in FIGS. 59-62, the DSCav1 substitutions could be successfully introduced into a RSV F glycoprotein B subtype to stabilize antigenic site Ø to generate a DSCav1 mutant on the subtype B background that specifically binds to prefusion specific antibodies. Table 25, below, provides a summary of the crystallographic data for DSCav1 on RSV F subtype B.

TABLE 25

Crystallographic data concerning DSCav1 subtype B

| | RSV B18537 F |
|---|---|
| PDB accession code | |
| Data collection | |
| Space group | P4$_1$32 |
| Cell constants | |
| a, b, c (Å) | 167.9, 167.9, 167.9 |
| a, b, g (Å) | 90, 90, 90 |
| Wavelength (Å) | 1.00 |
| Resolution (Å) | 50.0-1.94 (2.01-1.94) |
| R$_{merge}$ | 10 (78.8) |
| I/sI | 11.96 (1.12) |
| Completeness (%) | 95.9 (79.7) |
| Redundancy | 4.0 (2.4) |
| Refinement | |
| Resolution (Å) | 1.94 |
| Unique reflections | 57,616 |
| R$_{work}$/R$_{free}$ (%) | 18.71/21.52 |
| No. atoms | |
| Protein | 3552 |
| Ligand/ion | 5 |
| Water | 401 |
| B-factors (Å$^2$) | |
| Protein | 46.2 |
| Ligand/ion | 78.3 |
| Water | 53.2 |
| R.m.s. deviations | |
| Bond lengths (Å) | 0.009 |
| Bond angles (°) | 1.17 |
| Ramachandran | |
| Favored regions (%) | 96.18 |
| Allowed regions (%) | 3.82 |
| Disallowed regions (%) | 0 |

Example 12

Design and Production of Recombinant RSV F Proteins without a Trimerization Domain This example illustrated the design and production of recombinant RSV F proteins that are stabilized in a prefusion conformation but which do not include a C-terminal trimerization domain to maintain stability of the membrane proximal lobe of the RSV F protein.

Briefly, in place of the C-terminal trimerization domain, a ring of disulfide bonds is introduced into the C-terminus of the F1 polypeptide by substituting cysteine residues for amino acids of the α10 helix. The three α10 helixes of the RSV F Ectodomain for a coil-coil that stabilized the membrane proximal portion of the protein. When expressed in cells, inter-protomer disulfide bonds form between the cysteines introduced into the α10 helix, thereby "locking" the three α10 helix's in close proximity and preventing movement of the membrane proximal domain from the pre- to the post-fusion conformation. The α10 helix of the RSV F protein includes residues 492 to the transmembrane domain (residue 529).

In this example, the recombinant RSV F protein with the stabilizing cysteine ring is initially expressed as a recombinant protein that includes a trimerization domain. The trimerization domain can be proteolytically removed following initial expression. The cleavage can be performed before, after, or during purification of the RSV F protein. Currently we purify the RSV F protein using tendem Ni2+ IMAC and Streptactin immobilization steps via the C-terminal His6 and StrepII tag, followed by thrombin digestion at room temperature for 12 hours then separation of the foldon from the RSV F protein by size-exclusion chromatography. It would be possible to also purify the cleaved RSV F protein by ion exchange.

Figure 66:
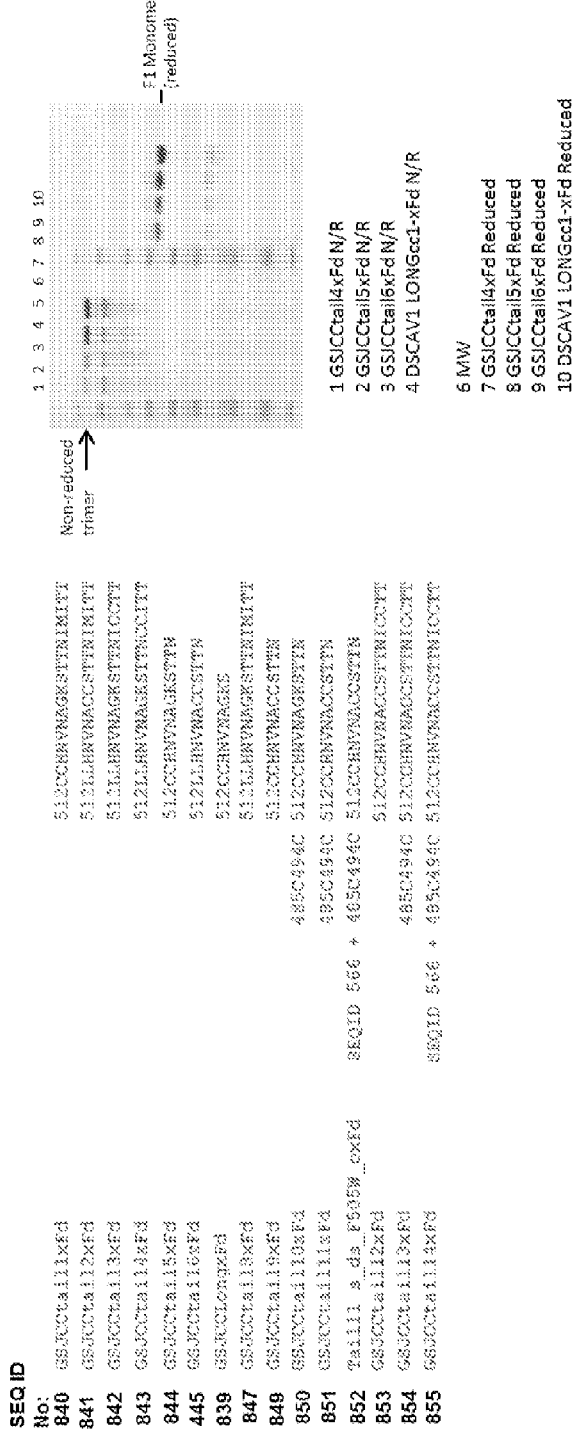
Figure 67:
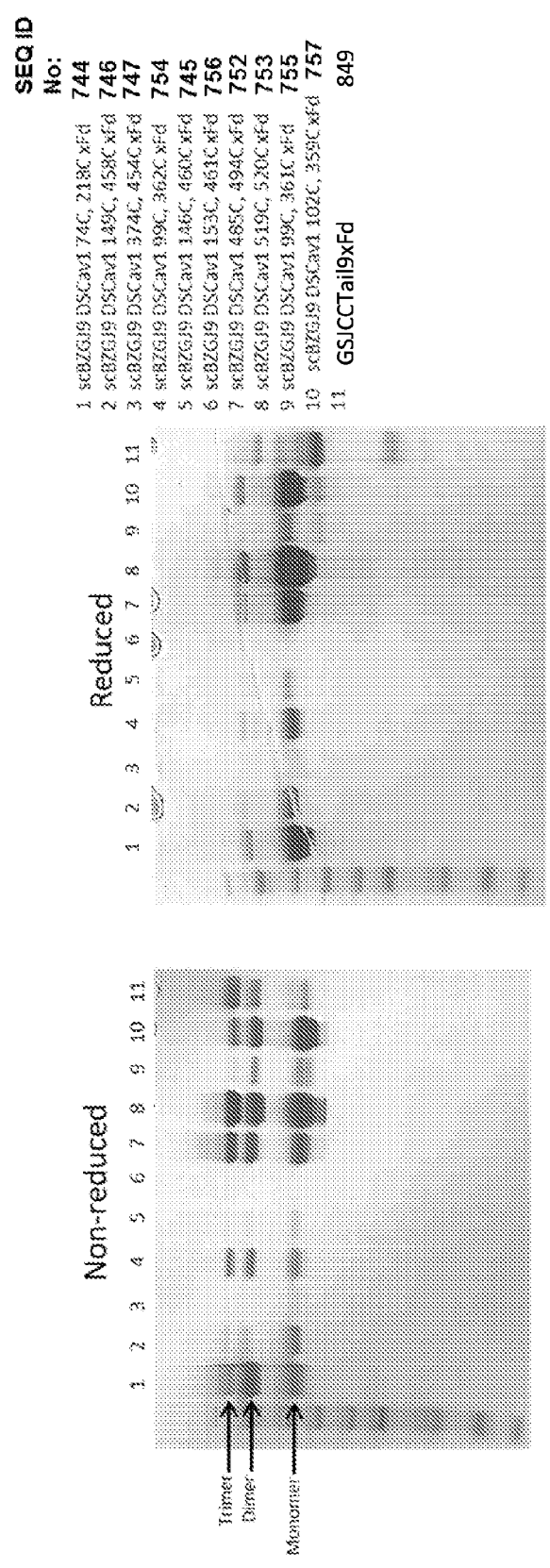
Figure 68:
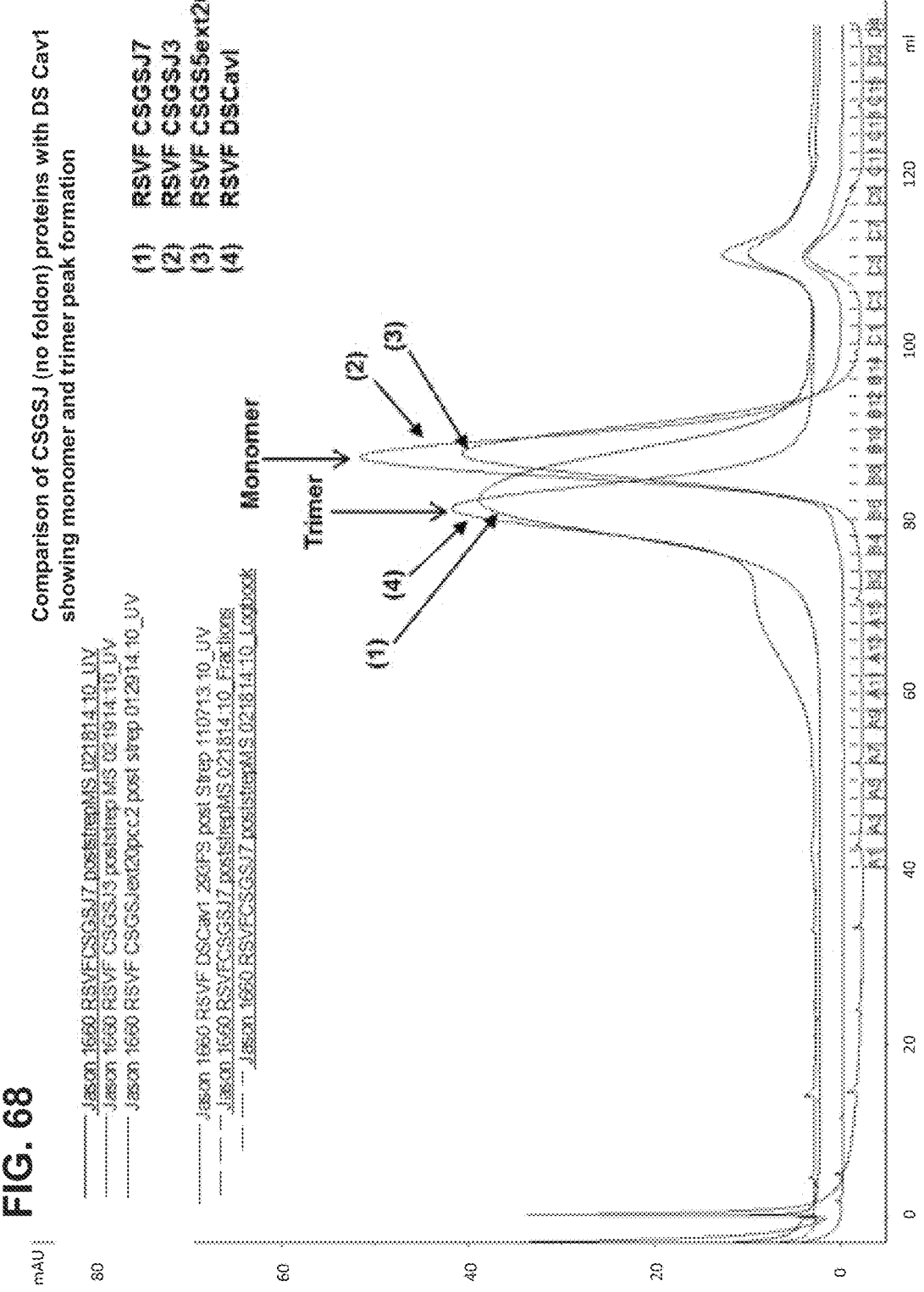

FIGS. 63-68 show gel filtration results and coommassie blue staining of reduced and non-reduced PAGE analysis of several of the recombinant F proteins without trimerization domain as designed listed below. Table 22 provides antigenic and physical characteristics of the indicated constructs, which include the DSCav1 substitutions, and cysteine substitutions in the α10 helix at positions 525 and 526 (CCTail4xFd), 512 and 513 (CCTail5xFd), 519 and 520 (CCTail6xFd), and 512 and 512 (CCLongxFd). The corresponding SEQ ID NO for each construct is shown in FIG. 66.

TABLE 22

Antigenic and physical characteristics of engineered RSV F glycoprotein variants.

| | Physical characterization (Fractional D25 reactivity) | | | | | |
|---|---|---|---|---|---|---|
| | 1 hour incubation Temp (°) | | pH | Osmolality (mM) | | 10 times Freeze- |
| Construct | 50 | 70 | 3.5 10 | 10 | 3000 | thaw |
| GSJ CCtail 4x Fd Uncleaved | 0.9 | 0.5 | 0.9 0.9 | 1.0 | .08 | 0.3 |
| GSJ CC tail 4x Fd Cleaved | 0.9 | 0.4 | 0.9 1.0 | 1.0 | 0.7 | 0.4 |
| GSJ CC tail 5x Fd Uncleaved | 0.9 | 0.6 | 0.9 1.0 | 1.0 | 0.7 | 0.2 |
| GSJ CC tail 5x Fd Cleaved | 0.9 | 0.2 | 0.9 1.0 | 1.0 | 1.0 | 0.2 |
| GSJ CCtail 6x Fd Uncleaved | 0.9 | 0.4 | 0.9 0.9 | 1.0 | 0.7 | 0.2 |

TABLE 22-continued

Antigenic and physical characteristics of engineered RSV F glycoprotein variants.

| | Physical characterization (Fractional D25 reactivity) | | | | | |
|---|---|---|---|---|---|---|
| | 1 hour incubation Temp (°) | pH | Osmolality (mM) | | 10 times Freeze-thaw | |
| Construct | 50  70 | 3.5  10 | 10  3000 | | |
| GSJ CC tail6 xFd Cleaved | 1.0  0.3 | 0.9  0.9 | 1.0  0.7 | 0.3 |
| GSJ CC tail Long xFd Unleaved | 0.9  0.1 | 0.7  0.8 | 0.8  0.6 | 0.1 |
| GSJ CC tail Long xFd Cleaved | 1.0  0.3 | 0.9  1.0 | 1.0  0.8 | 0.2 |

Several RSV F protein sequences without trimerization domains, or with a cleavable trimerization domain are provided in the SEQ ID NOs listed in Table 23, as well as an indication of design approach. The name, α10 cysteine ring, presence or absence of C-terminal Foldon or cleavable Foldon, background sequence (e.g., "DSCAV1" indicates that the construct includes the DSCav1 substitutions), the design concept, and corresponding SEQ ID NO are indicated. In Table 23, the following acronyms are used: DSCAV1: S155C, S290C, S190F, V207L substitutions; Op—Optimized coil coil; OpCC—Optimized Coil Coil with disulfides; InterC—Interprotomer disulfide at C-terminal helix; Multi-InterC—Multiple interprotomer disulfide stabilization; ECC: Enhanced coil-coil stability; FP-CC: Fusion peptide Cys bridge; 190P: 190 pocket alternative amino acid; Fd (non-cleavable Foldon), xFd (cleavable foldon), N (no Foldon); CFM: Cavity Filling mutation; ICFM: Interface cavity filling mutations The recombinant RSV F proteins with no or with a cleavable trimerization domain listed in Table 23 were expressed in cells under conditions where the proteins are secreted from the cells in the cell media as described above in Example 9. Each construct contains a leader sequence that causes the protein to enter the secretory system and be secreted. The medium was then centrifuged and the supernatant used for antigenicity testing for binding to the Site Ø specific antibody D25 and the Site II specific antibody Motavizumab ("Mota", FIGS. 69A-69E). The conditions tested include D25 and Mota binding on day 0 (conditions 1 and 2), D25 and Mota binding on day 0 after incubation at 70° C. for one hour (conditions 3 and 4), and D25 and Mota binding after 1 week at 4° C. (conditions 5 and 6). The control is the DSCav1 construct with a foldon domain. Specific antigenicity data for each construct is provided in FIGS. 69A-69E (the conditions tested are noted in the header rows).

TABLE 23

Recombinant RSV F proteins that lack a trimerization domain, or that have a protease cleavable trimerization domain.

| Construct Name | Motif | C-Term | Background | Design concept | SEQ ID NO |
|---|---|---|---|---|---|
| CS/GSJ ext2Opti1 | 512LLhnvnagLstVnimLttVI | N | DSCAV1 | Op | 829 |
| CS/GSJ ext2Opti2 | 512LLhnvnagLstVnKmLttVI | N | DSCAV1 | Op | 830 |
| CS/GSJ ext2Opti3 | 512LLhnvnKkLstVnKmLnVI | N | DSCAV1 | Op | 831 |
| CS/GSJ ext2OpCC1 | 512CChnvnagLstVnKmLttVI | N | DSCAV1 | OpCC | 832 |
| CS/GSJ ext2OpCC2 | 512LLhnvnaCCstVnKmLttVI | N | DSCAV1 | OpCC | 833 |
| CS/GSJ ext2OpCC3 | 512LLhnvnagLstVnKCCttVI | N | DSCAV1 | OpCC | 834 |
| CS/GSJ ext2OpCC4 | 512FQNAVESTINTLQTTLEAVAQAI | N | DSCAV1 | Op | 835 |
| CS/GSJ GCN4cc1 | 512IEDKIEEILSKQYHIENEIARCC | N | DSCAV1 | OpCC | 836 |
| CS/GSJ GCN4cc2 | 512CCDKIEEILSKQYHIENEIARIK | N | DSCAV1 | OpCC | 837 |
| CS/GSJ CartOp | 512LLhnvnagLstVnKmLttVIKcc | N | DSCAV1 | OpCC | 838 |
| GSJ CClongxFd | 512CCHNVNAGKSGG | xFd | DSCAV1 | InterC | 839 |
| GSJ CCtail1xFd | 512CChnvnagksttnimitt | xFd | DSCAV1 | InterC | 840 |
| GSJ CCtail2xfd | 512LLhnvnaCCsttnimitt | xFd | DSCAV1 | InterC | 841 |
| GSJ CCtail3xfd | 512LLhnvnagksttniCCtt | xFd | DSCAV1 | InterC | 842 |
| GSJ CCtail4xfd | 512LLhnvnagksttnCCitt | xFd | DSCAV1 | InterC | 843 |
| GSJ CCtail5xfd | 512CChnvnagksttn | xFd | DSCAV1 | InterC | 844 |
| GSJ CCtail6xfd | 512LLhnvnaCCsttn | xFd | DSCAV1 | InterC | 845 |
| GSJ CCtail7xfd | 512LLhnvnagksttn | xFd | DSCAV1 | Extended C-terminal helix | 846 |
| GSJ CCtail8xfd | 512LLhnvnagksttnimitt | xFd | DSCAV1 | Extended C-terminal helix | 847 |
| GSJ CCtail9.1xFd | 512CChnvnaCCsttnimitt | xFd | DSCAV1 | Multi-InterC | 848 |
| GSJ CCtail9xfd | 512CChnvnaCCsttn | xFd | DSCAV1 | Multi-InterC | 849 |
| GSJ CCtail10xFd | 485C494C 512Cchnvnagksttn | xFd | DSCAV1 | Multi-InterC | 850 |
| GSJ CCtail11xEd | 485C494C 512CchnvnaCCsttn | xFd | DSCAV1 | Multi-InterC | 851 |
| Tail11s_ds_F505W_oxFd | SeqID 566 + 485C494C 512CchnvnaCCsttn | xFd | SeqID 566 (Based on DSCav1) | Multi-InterC | 852 |
| GSJ CCtail12xFd | 512CChnvnaCCsttniCCtt | xFd | DSCAV1 | Multi-InterC | 853 |
| GSJ CCtail13xFd | 485C494C 512CchnvnaCCsttniCCtt | xFd | DSCAV1 | Multi-InterC | 854 |

TABLE 23-continued

Recombinant RSV F proteins that lack a trimerization domain, or that have a protease cleavable trimerization domain.

| Construct Name | Motif | C-Term | Background | Design concept | SEQ ID NO |
|---|---|---|---|---|---|
| GSJ CCtail14xFd | SeqID 566 + 485C494C 512CchnvnaCCsttniCCtt | xFd | SeqID 566 (Based on DSCav1) | Multi-InterC | 855 |
| GSJ CCtail15xEd | SeqID 566 + 485C494C 512CchnvnaCCsttn | xFd | SeqID 566 (Based on DSCav1) | Multi-InterC | 856 |
| GSJ CCtail16xFd | SeqID 566 + 485C494C 512CchnvnaGKsttniCCtt | xFd | SeqID 566 (Based on DSCav1) | Multi-InterC | 857 |
| GSJT11 | DSCav1-S509W, L512C, L513C | N | DSCAV1 | ECC | 858 |
| GSJT12 | DSCav1-S509F, L512C, L513C | N | DSCAV1 | ECC | 859 |
| GSJT13 | DSCav1-L512F, L513C, 514E, 515C | N | DSCAV1 | ECC | 860 |
| GSJT14 | DSCav1-S509W, L513C, 514E, 515C | N | DSCAV1 | ECC | 861 |
| GSJT15 | DSCav1-S509F, L513C, 514E, 515C | N | DSCAV1 | ECC | 862 |
| GSJT16 | DSCav1-S509W, L512F, L513C, 514E, 515C | N | DSCAV1 | ECC | 863 |
| GSJT17 | DSCav1-L512F, L513C, 514E, 515E, 516C | N | DSCAV1 | ECC | 864 |
| GSJT18 | DSCav1-S509W, L513C, 514E, 515E, 516C | N | DSCAV1 | ECC | 865 |
| GSJT19 | DSCav1-S509F, L513C, 514E, 515E, 516C | N | DSCAV1 | ECC | 866 |
| GSJT20 | DSCav1-S509W, L512F, L513C, 514E, 515E, 516C | N | DSCAV1 | ECC | 867 |
| GSJT21 | DSCav1-L512C, L513E, 514C | N | DSCAV1 | ECC | 868 |
| GSJT22 | DSCav1-L512C, L513E, 514E, 516C | N | DSCAV1 | ECC | 869 |
| GSJT23 | DSCav1-A515C, I516C | N | DSCAV1 | ECC | 870 |
| GSJT24 | DSCav1-L512T, L513E | N | DSCAV1 | ECC | 871 |
| GSJT25 | DSCav1-L512T, L513E, A515C, I516C | N | DSCAV1 | ECC | 872 |
| GSJT26 | DSCav1-L512S, L513E | N | DSCAV1 | ECC | 873 |
| GSJT27 | DSCav1-L512S, L513E, A515C, I516C | N | DSCAV1 | ECC | 874 |
| GSJT28 | DSCav1-L512S, L513D | N | DSCAV1 | ECC | 875 |
| GSJT29 | DSCav1-L512S, L513D, A515C, I516C | N | DSCAV1 | ECC | 876 |
| GSJT30 | DSCav1-L512F, A515C, I516C | N | DSCAV1 | ECC | 877 |
| GSJT31 | DSCav1-L513F, A515C, I516C | N | DSCAV1 | ECC | 878 |
| GSJT32 | DSCav1-L512F, L513F, A515C, I516C | N | DSCAV1 | ECC | 879 |
| GSJT33 | DSCav1-L512Y, L513Y, A515C, I516C | N | DSCAV1 | ECC | 880 |
| GSJT34 | DSCav1-L512F, L513Y, A515C, I516C | N | DSCAV1 | ECC | 881 |
| GSJT35 | DSCav1-L512W, L513W, A515C, I516C | N | DSCAV1 | ECC | 882 |
| GSJT36 | DSCav1-L5132W, L513Y, A515C, I516C | N | DSCAV1 | ECC | 883 |
| GSJT37 | DSCav1-S509W, A515C, I516C | N | DSCAV1 | ECC | 884 |
| GSJT38 | DSCav1-S509F, A515C, I516C | N | DSCAV1 | ECC | 885 |
| GSJT39 | DSCav1-S509W, L512F, A515C, I516C | N | DSCAV1 | ECC | 886 |
| GSJT40 | DSCav1-S509W, L512F, L513F, A515C, I516C | N | DSCAV1 | ECC | 887 |
| GSJT41 | DSCav1-S509F, L512A, L513A, A515C, I516C | N | DSCAV1 | ECC | 888 |
| GSJT42 | DSCav1-S509W, L512A, L513A, A515C, I516C | N | DSCAV1 | ECC | 889 |
| GSJT43 | DSCav1-F505W, I506W, S509F, L512C, L513C | N | DSCAV1 | ECC | 890 |
| GSJT44 | DSCav1-F505W, I506W, S509F, A515C, I516C | N | DSCAV1 | ECC | 891 |
| GSJT45 | DSCav1-F505W, I506W, S509F, L512S, L513E, A515C, I516C | N | DSCAV1 | ECC | 892 |
| GSJT46 | DSCav1-F505W, I506W, S509F, L512A, L513A, A515C, I516C | N | DSCAV1 | ECC | 893 |
| GSJT47 | DSCav1-F505K, I506D, S509F, L512C, L513C | N | DSCAV1 | ECC | 894 |

TABLE 23-continued

Recombinant RSV F proteins that lack a trimerization domain, or that have a protease cleavable trimerization domain.

| Construct Name | Motif | C-Term | Background | Design concept | SEQ ID NO |
|---|---|---|---|---|---|
| GSJT48 | DSCav1-F505K, I506D, S509F, A515C, I516C | N | DSCAV1 | ECC | 895 |
| GSJT49 | DSCav1-F505K, I506D, L512C, L513C | N | DSCAV1 | ECC | 896 |
| GSJT50 | DSCav1-F505K, I506D, A515C, I516C | N | DSCAV1 | ECC | 897 |
| GSJT51 | DSCav1-F505K, I506D, L512A, L513A, A515C, I516C | N | DSCAV1 | ECC | 898 |
| GSJT52 | DSCav1-F505K, I506D, L512S, L513E, L512C, L513C | N | DSCAV1 | ECC | 899 |
| GSJT53 | DSCav1-F505K, I506D, L512S, L513D, A515C, I516C | N | DSCAV1 | ECC | 900 |
| GSJ-FP1 | DSCav1-F137C, R339C | Fd | DSCAV1 | FP-CC | 969 |
| GSJ-FP2 | DSCav1-F137C, T337C | Fd | DSCAV1 | FP-CC | 970 |
| GSJ-FP3 | DSCav1-G139C, Q354C | Fd | DSCAV1 | FP-CC | 971 |
| GSJ-FP4 | F137C, R339C | Fd | DSCAV1 | FP-CC | 972 |
| GSJ-FP5 | F137C, T337C | Fd | DSCAV1 | FP-CC | 973 |
| GSJ-FP6 | G139C, Q354C | Fd | DSCAV1 | FP-CC | 974 |
| GSJ-190P1 | L260F | Fd | DSCAV1 | 190P | 975 |
| GSJ-190P2 | L260W | Fd | DSCAV1 | 190P | 976 |
| GSJ-190P3 | L260Y | Fd | DSCAV1 | 190P | 977 |
| GSJ-190P4 | L260R | Fd | DSCAV1 | 190P | 978 |
| GSJ-190P5 | L188F | Fd | DSCAV1 | 190P | 979 |
| GSJ-190P6 | L188W | Fd | DSCAV1 | 190P | 980 |
| GSJ-190P7 | L188Y | Fd | DSCAV1 | 190P | 981 |
| GSJ-190P8 | L188R | Fd | DSCAV1 | 190P | 982 |
| GSJ-190P9 | I57F | Fd | DSCAV1 | 190P | 983 |
| GSJ-190P10 | I57W | Fd | DSCAV1 | 190P | 984 |
| GSJ-190P11 | I57R | Fd | DSCAV1 | 190P | 985 |
| GSJ-190P12 | L252F | Fd | DSCAV1 | 190P | 986 |
| GSJ-190P13 | L252W | Fd | DSCAV1 | 190P | 987 |
| GSJ-190P14 | L252R | Fd | DSCAV1 | 190P | 988 |
| GSJ-190P15 | V192F | Fd | DSCAV1 | 190P | 989 |
| GSJ-190P16 | V192W | Fd | DSCAV1 | 190P | 990 |
| GSJ-190P17 | V192R | Fd | DSCAV1 | 190P | 991 |
| GSJ-DS1 | S150C, Y458C | Fd | DSCAV1 | Stabilizing Disulfides | 992 |
| GSJ-DS2 | A149C, N460C | Fd | DSCAV1 | Stabilizing Disulfides | 993 |
| GSJ-DS3 | S146C, N460C | Fd | DSCAV1 | Stabilizing Disulfides | 994 |
| GSJ-DS4 | A149C, Y458C | Fd | DSCAV1 | Stabilizing Disulfides | 995 |
| GJ-3-1 | V220F | Fd | DSCAV1 | CFM | 996 |
| GJ-3-2 | V220W | Fd | DSCAV1 | CFM | 997 |
| GJ-3-3 | V220M | Fd | DSCAV1 | CFM | 998 |
| GJ-3-4 | T219F | Fd | DSCAV1 | CFM | 999 |
| GJ-3-5 | T219M | Fd | DSCAV1 | CFM | 1000 |
| GJ-3-6 | T219W | Fd | DSCAV1 | CFM | 1001 |
| GJ-3-7 | T219R | Fd | DSCAV1 | CFM | 1002 |
| GSJ-Int-FdF-1 | I221F | Fd | DSCAV1 | ICFM | 1003 |
| GSJ-Int-FdF-2 | I221Y | Fd | DSCAV1 | ICFM | 1004 |
| GSJ-Int-FdF-3 | I221W | Fd | DSCAV1 | ICFM | 1005 |
| GSJ-Int-FdF-4 | Q224D, L78K | Fd | DSCAV1 | ICFM | 1006 |
| GSJ-Int-FdF-5 | V278F | Fd | DSCAV1 | ICFM | 1007 |
| GSJ-Int-FdF-6 | Q279F | Fd | DSCAV1 | ICFM | 1008 |
| GSJ-Int-FdF-7 | N277D, S99K | Fd | DSCAV1 | ICFM | 1009 |
| GSJ-Int-FdF-8 | Q361F | Fd | DSCAV1 | ICFM | 1010 |
| GSJ-Int-FdF-9 | V402F | Fd | DSCAV1 | ICFM | 1011 |
| GSJ-Int-FdF-10 | T400F | Fd | DSCAV1 | ICFM | 1012 |
| GSJ-Int-FdF-11 | T400W | Fd | DSCAV1 | ICFM | 1013 |
| GSJ-Int-FdF-12 | H486F | Fd | DSCAV1 | ICFM | 1014 |
| GSJ-Int-FdF-13 | H486W | Fd | DSCAV1 | ICFM | 1015 |
| GSJ-Int-FdF-14 | I217F | Fd | DSCAV1 | ICFM | 1016 |
| GSJ-Int-FdF-15 | I217Y | Fd | DSCAV1 | ICFM | 1017 |
| GSJ-Int-FdF-16 | I217W | Fd | DSCAV1 | ICFM | 1018 |
| DSCav1OpFd1 | F190V | Fd | DSCAV1 | Enhanced stability of DSCav1 | 1019 |
| DSCav1OpFd2 | K226L | Fd | DSCAV1 | Enhanced stability of DSCav1 | 1020 |

TABLE 23-continued

Recombinant RSV F proteins that lack a trimerization domain, or that have a protease cleavable trimerization domain.

| Construct Name | Motif | C-Term | Background | Design concept | SEQ ID NO |
|---|---|---|---|---|---|
| DSCav1OpFd3 | T58I, A298M | Fd | DSCAV1 | Enhanced stability of DSCav1 | 1021 |
| DSCav1OpFd4 | F190V, K226L | Fd | DSCAV1 | Enhanced stability of DSCav1 | 1022 |
| DSCav1OpFd5 | F190V, T58I, A298M | Fd | DSCAV1 | Enhanced stability of DSCav1 | 1023 |
| DSCav1OpFd6 | K226L, T58I, A298M | Fd | DSCAV1 | Enhanced stability of DSCav1 | 1024 |
| DSCav1OpFd7 | T58I, A298M, F190V, K226L | Fd | DSCAV1 | Enhanced stability of DSCav1 | 1025 |
| CSGSJ1 | | xFd | DSCAV1 | Engineered alpha 10 coil coil with GCN4 internal motifs | 1456 |
| CSGSJ2 | | xFd | DSCAV1 | Engineered alpha 10 coil coil with GCN4 internal motifs | 1457 |
| CSGSJ3 | | xFd | DSCAV1 | Engineered alpha 10 coil coil with GCN4 internal motifs | 1458 |
| CSGSJ4 | | xFd | DSCAV1 | Engineered alpha 10 coil coil with GCN4 internal motifs | 1459 |
| CSGSJ5 | | xFd | DSCAV1 | Engineered alpha 10 coil coil with GCN4 internal motifs | 1460 |
| CSGSJ6 | | xFd | DSCAV1 | Engineered alpha 10 coil coil with GCN4 internal motifs | 1461 |
| CSGSJ7 | | xFd | DSCAV1 | Engineered alpha 10 coil coil with GCN4 internal motifs | 1462 |
| BZGJ9-10-TMCC1 | | xFd | DSCAV1 | single chain F, alpha10 disulfide, Furin site, Foldon, TM region | 1463 |
| BZGJ9-10-TMCC2 | | xFd | DSCAV1 | single chain F, alpha10 disulfide, Furin site, Foldon, TM region | 1464 |
| GSJCCTail9-TMCC1 | | xFd | DSCAV1 | F, alpha10 disulfide, Furin site, Foldon, TM region | 1465 |
| GSJCCTail9-TMCC2 | | xFd | DSCAV1 | F, alpha10 disulfide, Furin site, Foldon, TM region | 1466 |
| GSJCCTail9-TMCC3 | | xFd | DSCAV1 | F, alpha10 disulfide, Furin site, TM region | 1467 |
| GSJCCTail9-TMCC4 | | xFd | DSCAV1 | F, alpha10 disulfide, Furin site, TM region | 1468 |

The yield of protein was calculated for several of the recombinant F proteins, and is shown below in Table 26.

TABLE 26

Yield of recombinant RSV F protein expression

| Design Name | Yield mg/L | SEQ ID NO |
|---|---|---|
| CS/GSJ ext2OpCC1 | 0.39 | 832 |
| CS/GSJ ext2OpCC2 | 0.33 | 833 |
| CS/GSJ ext2OpCC3 | 0.72 | 834 |
| CS/GSJ ext2OpCC4 | 0.48 | 835 |
| CS/GSJ GCN4cc1 | 2.85 | 836 |
| CS/GSJ GCN4cc2 | 0.75 | 837 |
| CS/GSJ CartOp | 0.36 | 838 |
| GSJ CClongxFd | 6.3 | 839 |
| GSJ CCtail1xFd | 1.05 | 840 |
| GSJ CCtail2xFd | 0.33 | 841 |
| GSJ CCtail3xFd | 0.99 | 842 |
| GSJ CCtail4xFd | 1.53 | 843 |
| GSJ CCtail5xFd | 2.13 | 844 |
| GSJ CCtail6xFd | 1.65 | 845 |
| CSGSJ7 | 0.66 | 1462 |
| GSJ 1Cav1 13 | 8 | 913 |
| JCB GSJ 4 | 8 | 942 |
| JCB GSJ 5 | 8 | 943 |

Example 13

Additional Mutations to Stabilize the Membrane Distal Portion of the RSV F Ectodomain This example illustrates additional mutations that were made to RSV F to stabilize the protein in its prefusion conformation.

Several RSV F protein sequences without trimerization domains were designed and are provided in the SEQ ID NOs listed in Table 24, as well as an indication of design approach. The name, mutation relative to SEQ ID NO: 1026, presence or absence of C-terminal Foldon domain, background sequence (e.g., "WT" indicates wild-type RSV F), the design concept, and corresponding SEQ ID NO are indicated.

The recombinant RSV F proteins with a C-terminal trimerization domain listed in Table 24 were expressed in cells under conditions where the proteins are secreted from the cells in the cell media. Each construct contains a leader sequence that causes the protein to enter the secretory system and be secreted as described above in Example 9. The medium was then centrifuged and the supernatant used for antigenicity testing for binding to the Site Ø specific antibody D25 and the Site II specific antibody Motavizumab ("Mota", FIGS. 69A-69E). The conditions tested include D25 and Mota binding on day 0 (conditions 1 and 2), D25 and Mota binding on day 0 after incubation at 70° C. for one hour (conditions 3 and 4), and D25 and Mota binding after 1 week at 4° C. (conditions 5 and 6). The control is the DSCav1 construct with a foldon domain. Specific antigenicity data for each construct is provided in FIGS. 69A-69E (the conditions tested are noted in the header rows).

TABLE 24

New stabilization with Foldon domain

| Construct Name | Mutation(s) relative to SEQ ID NO: 1026 | C-Term | Back-ground | Design concept | SEQ ID NO |
|---|---|---|---|---|---|
| GSJ 1Cav1 1 | S190W | Fd | WT | S190 AA Scan | 901 |
| GSJ 1Cav1 2 | S190L | Fd | WT | S190 AA Scan | 902 |
| GSJ 1Cav1 3 | S190R | Fd | WT | S190 AA Scan | 903 |
| GSJ 1Cav1 4 | S190E | Fd | WT | S190 AA Scan | 904 |
| GSJ 1Cav1 5 | S190A | Fd | WT | S190 AA Scan | 905 |
| GSJ 1Cav1 6 | S190Q | Fd | WT | S190 AA Scan | 906 |
| GSJ 1Cav1 7 | S190Y | Fd | WT | S190 AA Scan | 907 |
| GSJ 1Cav1 8 | S190G | Fd | WT | S190 AA Scan | 908 |
| GSJ 1Cav1 9 | S190P | Fd | WT | S190 AA Scan | 909 |
| GSJ 1Cav1 10 | S190I | Fd | WT | S190 AA Scan | 910 |
| GSJ 1Cav1 11 | S190T | Fd | WT | S190 AA Scan | 911 |
| GSJ 1Cav1 12 | S190C | Fd | WT | S190 AA Scan | 912 |
| GSJ 1Cav1 13 | S190V | Fd | WT | S190 AA Scan | 913 |
| GSJ 1Cav1 14 | S190D | Fd | WT | S190 AA Scan | 914 |
| GSJ 1Cav1 15 | S190N | Fd | WT | S190 AA Scan | 915 |
| GSJ 1Cav1 16 | S190H | Fd | WT | S190 AA Scan | 916 |
| GSJ 1Cav1 17 | S190K | Fd | WT | S190 AA Scan | 917 |
| GSJ 1Cav1 18 | DS V207L | Fd | WT | S190 AA Scan | 918 |
| GSJ 1Cav1 19 | DS S190F | Fd | WT | S190 AA Scan | 919 |
| GSJ 1Cav1 20 | V207O | Fd | WT | S190 AA Scan | 920 |
| GSJ 1Cav1 21 | V207A | Fd | WT | S190 AA Scan | 921 |
| GSJ 1Cav1 22 | V207S | Fd | WT | S190 AA Scan | 922 |
| GSJ 1Cav1 23 | V207T | Fd | WT | S190 AA Scan | 923 |
| GSJ 1Cav1 24 | V207C | Fd | WT | S190 AA Scan | 924 |
| GSJ 1Cav1 25 | V207L | Fd | WT | S190 AA Scan | 925 |
| GSJ 1Cav1 26 | V207I | Fd | WT | S190 AA Scan | 926 |
| GSJ 1Cav1 27 | V207M | Fd | WT | S190 AA Scan | 927 |
| GSJ 1Cav1 28 | V207P | Fd | WT | S190 AA Scan | 928 |
| GSJ 1Cav1 29 | V207F | Fd | WT | S190 AA Scan | 929 |
| GSJ 1Cav1 30 | V207Y | Fd | WT | S190 AA Scan | 930 |
| GSJ 1Cav1 31 | V207W | Fd | WT | S190 AA Scan | 931 |
| GSJ 1Cav1 32 | V207D | Fd | WT | S190 AA Scan | 932 |
| GSJ 1Cav1 33 | V207E | Fd | WT | S190 AA Scan | 933 |
| GSJ 1Cav1 34 | V207N | Fd | WT | S190 AA Scan | 934 |
| GSJ 1Cav1 35 | V207Q | Fd | WT | S190 AA Scan | 935 |
| GSJ 1Cav1 36 | V207H | Fd | WT | S190 AA Scan | 936 |
| GSJ 1Cav1 37 | V207K | Fd | WT | S190 AA Scan | 937 |
| GSJ 1Cav1 38 | V207R | Fd | WT | S190 AA Scan | 938 |
| JCB GSJ 1 | Y198F | Fd | WT | Probing JCB16/18/24 residues | 939 |
| JCB GSJ 2 | T219L | Fd | WT | Probing JCB16/18/24 residues | 940 |
| JCB GSJ 3 | V296I | Fd | WT | Probing JCB16/18/24 residues | 941 |
| JCB GSJ 4 | K226M | Fd | WT | Probing JCB16/18/24 residues | 942 |
| JCB GSJ 5 | I(226L | Fd | WT | Probing JCB16/18/24 residues | 943 |
| IG1-V192M | V192M | Fd | WT | | 944 |
| IG2-A298M_RSVF(+)FdTHS-paH | A298M | Fd | WT | | 945 |
| IG2-T58I_A298M | T58I_A298M | Fd | WT | | 946 |
| IG2-T58I_V192F_A298I_RSVF(+)FdTHS-paH | T58I, V192F, A298I | Fd | WT | | 947 |
| IG2-T58I_V192M_A298I_RSVF(+)FdTHS-paH | T58I, V192M, A298I | Fd | WT | | 948 |
| i167m-a298m | I167M, A298M | Fd | WT | | 949 |
| i167m-l181m | I167M, L181M | Fd | WT | | 950 |
| i199f | I199F | Fd | WT | | 951 |
| i57c-s190c | I57C, S190C | Fd | WT | | 952 |
| ig2-t58l-a298m | T58L, A298M | Fd | WT | | 953 |
| ig2-t58m | T58M | Fd | WT | | 954 |

TABLE 24-continued

New stabilization with Foldon domain

| Construct Name | Mutation(s) relative to SEQ ID NO: 1026 | C-Term | Background | Design concept | SEQ ID NO |
|---|---|---|---|---|---|
| ig2-t58m-a298i | T58M, A298I | Fd | WT | | 955 |
| ig2-t58m-a298L | T58M, A298L | Fd | WT | | 956 |
| ig2-v192c-ins192-193-g-e256c | V192C, G insertion 192/193, E256C | Fd | WT | | 957 |
| rsv f ths_s_f505w_o_s509f | ths_s_F505W_o_S509F | N | WT | | 958 |
| rsv f ths_s_f505w_s509f | ths_s_F505W_S509F | N | WT | | 959 |
| t58i-a298i | T58I, A298I | Fd | WT | | 960 |
| t58m-a298m | T58M, A298M | Fd | WT | | 961 |
| v179l-t189f | V179L, T189F | Fd | WT | | 962 |
| v192f | V192F | Fd | WT | | 963 |
| v192f-l252a | V192F, L252A | Fd | WT | | 964 |
| v56m-i167m-l181m | V56M, I167M, L181M | Fd | WT | | 965 |
| v56m-i167m-v296m | V56M, I167M, V296M | Fd | WT | | 966 |
| v56m-l181f | V56M, L181F | Fd | WT | | 967 |
| w52c-s150c | W52C, S150C | Fd | WT | | 968 |

Example 14

Minimal Site Ø Immunogens

The site Ø epitope of RSV F is located on the apex of the trimer spike and includes the region recognized by the three neutralizing antibodies D25, AM22 and 5C4. More specifically, as delineated by the crystal structure of the RSV F/D25 complex, this epitope comprises the outer surface of helix α4 (residues 196-210) and the adjacent loop (residues 63-68) between β2 and α1. This example illustrates the design and characterization of antigens that present site Ø alone with minimal adjoining residues, and which can be used to elicit a site Ø immune response and can be more cost effective to produce than full length pre-fusion stabilized RSV F trimer.

General Concepts for the Design of Minimal Site Ø RSV F Immunogens

The minimal site Ø immunogens were designed utilizing four primary design concepts: circular permutation, scaffolded circular permutation, domain III immunogens, and multimerization.

Circular permutations involve altering the native connections within a protein structure while keeping the spatial orientation(s) of the component parts. The minimal site Ø epitope components α4 and the β2-α1 loop are each part of two separate loop segments within RSV F1. To create stable site Ø folds, the two loop segments were connected (C-terminal to N-terminal) with short flexible amino acid linkers in the two different possible orders, thereby creating two separate folds, each of which preserve the site Ø epitope (FIG. 70A).

To create scaffolded circular permutations, the short flexible linkers of circularly permutated site Ø proteins were replaced by small rigid segments from other proteins that potentially provide greater stability than simple amino acid linkers (FIG. 70B).

Domain III (residues 50-306) is a larger domain of approximately 250 amino acids of the RSV F protein that contains the site Ø epitope (see FIG. 70D). The domain III residues surrounding site Ø provides further structural stability to site Ø while not adding significant additional distracting surface epitopes to the immunogen. Domain III contains a natural furin cleavage site between residues 136 and 137 which exposes the fusion peptide. Domain III can be further stabilized by replacing the cleavage site with an amino acid linker or by performing a circular permutation to link the original N- and C-termini or domain III and create a new N- and C-termini at the cleavage site. Both of these methods were utilized to stabilize various domain III immunogens.

Lastly, site Ø immunogens were multimerized to enhance immunogenicity (FIGS. 70D and 70E). Trimerization was utilized to mimic the native trimer observed in the pre-fusion RSV F viral spike and larger defined oligomers such as 24mers and 60mers were utilized to specifically enhance immunogenicity. The was accomplished by introducing disulfide bonds between constructs, or by covalently linking constructs together as dimers or trimers using amino acid linkers or by linking constructs to multimerization domains using amino acid linkers. Some constructs utilized a combination of these strategies. The smallest multimerization domains used were trimers (e.g. GCN4) and the largest were 60mers (e.g. lumazine synthase). We also used pentamers, 12mers and 24mers.

In addition to the major design concepts delineated above, the immunogens were stabilized by using several other methods including addition of disulfide bonds, cavity filling mutations, reduction of surface hydrophobicity, addition of charged surface residues, and addition of N-linked glycans and truncation of potentially flexible regions. A listing of several minimal site Ø immunogens is provided in Tables 20 (site Ø non-particle immunogens) and 21 (site Ø immunogens on a protein nanoparticle), as well as an indication of design approach. The name, concept, residues of RSV F protein, scaffold or other added protein, and corresponding SEQ ID NO are indicated. In Tables 20 and 21, the following acronyms are used: SØ: minimal Site Ø; CP: circular permutation; DS: Disulfide; CAV: cavity filling; Charge: Adding charged residues; SC: single chain; TD3: tandem domain III domain; D3: domain III; RH: Reduce Hydrophobicity; Fd: T4 Fd trimerization domain; CCMPTD: chicken cartilage matrix protein trimerization domain; MTQ-CC: MTQ coiled coil trimerization motif; CXVIII: Collagen XVIII trimerization domain; 2M0E: Miz-1 zinc finger 6 (2M0E) scaffold; ATCase: aspartate carbamoyltransferase (ATCase) trimerization domain (1GQ3); GCN4: GCN4 trimerization domain; Fer: Ferritin; Dps: *Microbacterium Arborescens* Dps; LS: A. aeolicus Lumazine Synthase; Thr: thrombin; EH: exposed hydrophobic; HCP1: *P. aeruginosa* hcp1 (1y12).

The minimal site Ø immunogens were expressed in cells using a system that results in secretion of the minimal site Ø immunogens into the tissue culture medium as described above in Example 9. The medium was then centrifuged and the supernatant used for antigenicity testing for binding to the Site Ø specific antibodies D25, AN22 and 5C4 by ELISA (FIGS. 72A-72F). The conditions tested include D25 binding after 0 and 1 week at 4° C. (conditions 1 and 2), D25 binding after 1 hr. at 60° C. (condition 3), 70° C. (condition 4), 80° C. (condition 5), 90° C. (condition 6), or 100° C. (condition 7), AM22 binding after two weeks at 4° C. (condition 8), 5C4 binding at week 0 4° C. (condition 9). The average of D25, AM22, and D25 binding after 1 hour at 70° C. is also shown (condition 10). A summary of the antigenicity data is provided in FIG. 71, which shows the number of site Ø immunogens that fall within each design category and which produced an ELISA result of at least 1.5. Specific antigenicity data for each construct is provided in FIGS. 72A-72F (the conditions tested are noted in the header rows). The results indicate that the minimal site Ø immunogens specifically bind to prefusion specific antibodies; and thus, are useful for inducing an immune response in a subject to antigenic site Ø. Additionally, the results indicate that the minimal site Ø constructs can be used as probes for isolating and detecting RSV F prefusion specific antibodies from a sample.

Based on the antigenicity data, 14 of the initial constructs were selected as representative for evaluation in animal models for producing an immune response, and for additional physical and structural characterization. The metric for choosing the 14 included selecting constructs showing average of ELISAs for D25 (week 1), AM22 (week 2) and D25 after 1 hour at 70 degrees. To prevent several very similar constructs being chosen for each category, each of the categories was subdivided into further categories (SEQ ID NO in parentheses):
Category 1: Monomers:
site Ø circular permutation: TZ-13 (354567-108) Avg: 3.18 (SEQ ID NO: 1040)
site Ø circular permutation with scaffold: JG_2KN0 (354567-417) Avg: 3.00 (SEQ ID NO: 1053)
domain III: E-CP_RBD51-307_14 mutDS-Cav1_THS (354567-273) Avg: 3.17 (SEQ ID NO: 1156)
domain III dimer: GSJnh4-TWIN (354567-693) Avg: 3.06 (SEQ ID NO: 1194)
Category 2: Trimers:
site Ø circular permutations: TZ-19 (354567-126) Avg: 3.08 (SEQ ID NO: 1106)
domain III (two are tied): RSVF(+)THS_s_to_hp2_foldon (354567-210) Avg: 3.08 (SEQ ID NO: 1170), and MS_08 (354567-447) Avg: 3.08 (SEQ ID NO: 1188)
domain III dimer: GSJnh4Fd-TWIN (354567-705) Avg: 3.01 (SEQ ID NO: 1212)
Category 3: Multivalent Monomers:
site Ø circular permutation on ferritin: 2m0e-resurf1-Ferritin (354567-621) Avg: 2.81 (SEQ ID NO: 1276)
domain III on ferritin: GSJnh2F (354567-471) Avg: 3.10 (SEQ ID NO: 1220)
monomer on a non-ferritin oligomer: LS1-E-CP_RBD51-307_11 mutDS-Cav1_THS (354567-315) Avg: 2.72 (SEQ ID NO: 1281)
Additional: MP11 (354567-642) Avg: 3.05 (SEQ ID NO: 1263)
Category 4: Multivalent Trimers:
domain III on nanoparticles (2): GSJnh2Fd-F (354567-483) Avg: 2.57 (SEQ ID NO: 1266), and GSJnh4Fd-F (354567-489) Avg: 2.02 (SEQ ID NO: 1268)

TABLE 20

Minimal Site Ø immunogens (not on a protein nanoparticle)

| Name | Concept | Region of RSVF (residue #s) | scaffold or other added protein | SEQ ID NO |
|---|---|---|---|---|
| Circular permutation of site Ø (26) | | | | |
| JCB_01 | CP-SØ + CAV | 60-94, 192-232 | APGG linker(Seq_1454) | 1027 |
| JCB_02 | CP-SØ + CAV | 60-94, 192-232 | APGG(Seq_1454) linker, DS | 1028 |
| JCB_03 | CP-SØ + CAV | 60-94, 192-232 | APGG(Seq_1454) linker, DS | 1029 |
| JCB_04 | CP-SØ + CAV | 60-94, 192-232 | AGSG(Seq_1455) linker | 1030 |
| JCB_05 | CP-SØ + CAV | 60-94, 192-232 | AGSG(Seq_1455) linker, DS | 1031 |
| JCB_06 | CP-SØ + CAV | 60-94, 192-232 | AGSG(Seq_1455) linker, DS | 1032 |
| JCB_07 | CP-SØ + CAV | 60-94, 192-229 | GSG linker | 1033 |
| JCB_08 | CP-SØ + CAV | 60-94, 192-229 | GSG linker, DS | 1034 |
| JCB_09 | CP-SØ + CAV | 60-94, 192-229 | GSG linker, DS | 1035 |
| TZ-09 | CP-SØ + DS + CAV + glycan | 192-242, 60-97 | GGSGSGG(Seq_1446) linker | 1036 |
| TZ-10 | CP-SØ + DS + CAV + charge | 192-242, 60-97 | GGSGSGG(Seq_1446) linker | 1037 |
| TZ-11 | shorter CP-SØ + DS + CAV + charge | 192-242, 60-97 | GGSGSGG(Seq_1446) linker | 1038 |
| TZ-12 | CP-SØ + DS + CAV + charge | 192-242, 60-97 | GGSGSGG(Seq_1446) linker | 1039 |
| TZ-13 | CP-SØ + DS + CAV + glycan | 192-242, 60-97 | GGSGSGG(Seq_1446) linker | 1040 |
| TZ-14 | CP-SØ + DS + CAV + glycan | 192-242, 60-97 | GGSGSGG(Seq_1446) linker | 1041 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| RSVF(+)THS_me | CP-SØ | 62-69 - ggsgggsggsg (Seq_1447) - 196-212 | Ggsgggsggsg(Seq_1447) linker | 1042 |
| RSVF(+)THS_me_hp1 | CP-SØ | 62-69 - ggsgggsggsg (Seq_1447) - 196-212 | ggsgggsggsg(Seq_1447) linker | 1043 |
| RSVF(+)THS_me_ds | CP-SØ | 62-69 - ggsgggsggsg (Seq_1447) - 196-212 | ggsgggsggsg(Seq_1447) linker | 1044 |
| RSVF(+)THS_me_hp1_ds | CP-SØ | 62-69 - ggsgggsggsg (Seq_1447) - 196-212 | ggsgggsggsg(Seq_1447) linker | 1045 |
| JG_circ1 | CP-SØ | 60-94, 193-237 | GGSGG(Seq_1448) linker | 1046 |
| JG_circ1_ds | CP-SØ + DS | 60-94, 193-237 | GGSGG(Seq_1448) linker | 1047 |
| JG_circ1_delK | CP-SØ + deletion | 60-94, 193-237 | GGSGG(Seq_1448) linker | 1048 |
| JG_circ1_sol_ds | CP-SØ + DS | 60-94, 193-237 | GGSGG(Seq_1448) linker | 1049 |
| JG_circ1_sol | CP-SØ | 60-94, 193-237 | GGSGG(Seq_1448) linker | 1050 |
| JG_Circ2 | CP-SØ | 60-75, 193-218 | GGSGG(Seq_1448) linker | 1051 |
| JG_Circ2_sol | CP-SØ | 60-75, 193-218 | GGSGG(Seq_1448) linker | 1052 |

Circular permutation with scaffold connection (19)

| JG_2KN0 | CP-SØ + section of TENC1 (2KN0) scaffold | 60-75, 193-218 | GGSGGSG(Seq_1445) linker and TENC1 (2KN0) scaffold | 1053 |
| Site_0_2a90_1_GYC | CP-SØ + CAV + RH + section of 2A90 scaffold | 61-96, 192-235 | WWE domain fragment (2A90) | 1054 |
| Site_0_2a90_2_GYC | CP-SØ + CAV + RH + DS + section of 2A90 scaffold | 61-96, 192-235 | WWE domain fragment (2A90) | 1055 |
| Site_0_2a90_3_GYC | CP-SØ + CAV + RH + DS + section of 2A90 scaffold | 61-96, 192-235 | WWE domain fragment (2A90) | 1056 |
| Site_0_2w59_1_GYC | CP-SØ + CAV + RH + section of 2W59 scaffold | 60-96, 193-238 | IgY fragment (2W59) | 1057 |
| Site_0_2w59_2_GYC | CP-SØ + CAV + RH + DS + section of 2W59 scaffold | 60-96, 193-238 | IgY fragment (2W59) | 1058 |
| Site_0_2w59_3_GYC | CP-SØ + CAV + RH + DS + section of 2W59 scaffold | 60-96, 193-238 | IgY fragment (2W59) | 1059 |
| Site_0_3u2e_1_GYC | CP-SØ + CAV + RH + section of 3U2E scaffold | 61-96, 192-238 | EAL domain fragment (3U2E) | 1060 |
| Site_0_3u2e_2_GYC | CP-SØ + CAV + RH + DS + section of 3U2E scaffold | 61-96, 192-238 | EAL domain fragment (3U2E) | 1061 |
| Site_0_3u2e_3_GYC | CP-SØ + CAV + RH + DS + section of 3U2E scaffold | 61-96, 192-238 | EAL domain fragment (3U2E) | 1062 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| Site_0_2vj1_1_GYC | CP-SØ + CAV + RH + section of 2VJ1 scaffold | 61-96, 192-240 | SARS proteinase fragment (2VJ1) | 1063 |
| Site_0_2vj1_2_GYC | CP-SØ + CAV + RH + DS + section of 2VJ1 scaffold | 61-96, 192-240 | SARS proteinase fragment (2VJ1) | 1064 |
| Site_0_2vj1_3_GYC | CP-SØ + CAV + RH + DS + section of 2VJ1 scaffold | 61-96, 192-240 | SARS proteinase fragment (2VJ1) | 1065 |
| Site_0_1chd_1_GYC | CP-SØ + CAV + RH + section of 1CHD scaffold | 60-95, 192-240 | CheB methylesterase fragment (1CHD) | 1066 |
| Site_0_1chd_2_GYC | CP-SØ + CAV + RH + DS + section of 1CHD scaffold | 60-95, 192-240 | CheB methylesterase fragment (1CHD) | 1067 |
| Site_0_1chd_3_GYC | CP-SØ + CAV + RH + DS + section of 1CHD scaffold | 60-95, 192-240 | CheB methylesterase fragment (1CHD) | 1068 |
| Site_0_1pgz_1_GYC | CP-SØ + CAV + RH + section of 1PQZ scaffold | 60-96, 192-239 | Immunomodulatory protein M144 fragment (1PQZ) | 1069 |
| Site_0_1pgz_2_GYC | CP-SØ + CAV + RH + DS + section of 1PQZ scaffold | 60-96, 192-239 | Immunomodulatory protein M144 fragment (1PQZ) | 1070 |
| Site_0_1pgz_3_GYC | CP-SØ + CAV + RH + DS + section of 1PQZ scaffold | 60-96, 192-239 | Immunomodulatory protein M144 fragment (1PQZ) | 1071 |
| Circular permutation of site Ø with trimer (39) | | | | |
| JCB_10 | CP-SØ + CAV + GCN4 | 60-94, 192-232 | APGG linker, GCN4 | 1072 |
| JCB_11 | CP-SØ + CAV + DS + GCN4 | 60-94, 192-232 | APGG linker, GCN4 | 1073 |
| JCB_12 | CP-SØ + CAV + DS + GCN4 | 60-94, 192-232 | APGG linker, GCN4 | 1074 |
| JCB_13 | CP-SØ + CAV + DS + GCN4 | 60-94, 192-232 | APGG linker, GCN4 | 1075 |
| JCB_14 | CP-SØ + CAV + DS + GCN4 | 60-94, 192-232 | APGG linker, GCN4 | 1076 |
| JCB_15 | CP-SØ + CAV + DS + GCN4 | 60-94, 192-232 | APGG linker, GCN4 | 1077 |
| JCB_16 | CP-SØ + CAV + GCN4 | 60-94, 192-229 | GSG linker, GCN4 | 1078 |
| JCB_17 | CP-SØ + CAV + DS + GCN4 | 60-94, 192-229 | GSG linker, DS, GCN4 | 1079 |
| JCB_18 | CP-SØ + CAV + DS + GCN4 | 60-94, 192-229 | GSG linker, DS, GCN4 | 1080 |
| JCB_19 | CP-SØ + CAV + DS + GCN4 | 60-94, 192-229 | GSG linker, GCN4 | 1081 |
| JCB_20 | CP-SØ + CAV + DS + GCN4 | 60-94, 192-229 | GSG linker, DS, GCN4 | 1082 |
| JCB_21 | CP-SØ + CAV + DS + GCN4 | 60-94, 192-229 | GSG linker, DS, GCN4 | 1083 |
| TZ-01 | CP-SØ + interchain DS | 192-242, 60-97 | GGSGSGG(Seq_1446) linker | 1084 |
| TZ-02 | CP-SØ + interchain DS + CAV | 192-242, 60-97 | GGSGSGG(Seq_1446) linker | 1085 |
| TZ-03 | CP-SØ + interchain DS + CAV | 192-242, 60-97 | GGSGSGG(Seq_1446) linker | 1086 |
| TZ-04 | CP-SØ + interchain DS + CAV | 192-242, 60-97 | GGSGSGG(Seq_1446) linker | 1087 |
| TZ-05 | CP-SØ + interchain DS + CAV + charge | 192-242, 60-97 | GGSGSGG(Seq_1446) linker | 1088 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| TZ-06 | CP-SØ + interchain DS + CAV + charge | 192-242, 60-97

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| 2m0e-resurf3 | Minimal SØ on 2M0E | | 2M0E | 1123 |
| 2M0E_r04 | Minimal SØ on 2M0E | 196-212 | 2M0E | 1124 |
| 2M0E_r05 | Minimal SØ on 2M0E | 196-212 | 2M0E | 1125 |
| 2M0E_r06 | Minimal SØ on 2M0E | 196-212 | 2M0E | 1126 |
| Domain III (42) | | | | |
| RBD51-307 11mut DS-Cav1 | D3 + DS + RH | 51-307 | | 1127 |
| RBD51-307 11mut DS-Cav1 2sug | D3 + DS + RH, add glycans | 51-307 | | 1128 |
| RBD51-304 11mut DS-Cav1 3sug | D3 + DS + RH, add glycans | 51-304 | | 1129 |
| RBD51-307 10mut DS-Cav1 | D3 + reduce hydrophobicity | 51-307 | | 1130 |
| RBD51-307 10mut DS-Cav1 2sug | D3 + RH, add glycans | 51-307 | | 1131 |
| RBD51-304 10mut DS-Cav1 3sug | D3 + RH, add glycans | 51-304 | | 1132 |
| CP RBD51-307 11mut DS-Cav1 | CP-D3 + DS, RH | 51-307 | | 1133 |
| CP RBD51-307 11mut DS-Cav1 2sug | CP-D3 + DS, RH | 51-307 | | 1134 |
| CP RBD51-304 11mut DS-Cav1 3sug | CP-D3 + DS, RH | 51-304 | | 1135 |
| CP RBD51-307 10mut DS-Cav1 | CP-D3, RH | 51-307 | | 1136 |
| CP RBD51-307 10mut DS-Cav1 2sug | CP-D3, RH, add glycans | 51-307 | | 1137 |
| CP RBD51-304 10mut DS-Cav1 3sug | CP-D3, RH, add glycans | 51-304 | | 1138 |
| JCB_28 | D3 + CAV | 50-96, 149-306 | GSGGGSG(Seq_1450) linker | 1139 |
| JCB_29 | D3 + CAV | 50-96, 149-306 | GSGGGSG(Seq_1450) linker | 1140 |
| RSVF(+)THS_s_to | CP-D3 + DS-Cav1 | 146-306 - ggsgg(Seq_1448) - 50-105 | GGSGG(Seq_1448) linker | 1141 |
| RSVF(+)THS_s_to_hp2 | CP-D3, RH + DS-Cav1 | 146-306 - ggsgg(Seq_1448) - 50-105 | GGSGG(Seq_1448) linker | 1142 |

TABLE 20-continued

Minimal Site 0 immunogens (not on a protein nanoparticle)

| Name | Concept | Region of RSVF (residue #s) | scaffold or other added protein | SEQ ID NO |
|---|---|---|---|---|
| RSVF(+)THS_s_to_hp12 | CP-D3, RH + DS-Cav1 | 146-306 - ggsgg(Seq_1448) - 50-105 | GGSGG(Seq_1448) linker | 1143 |
| RSVF(+)THS_s_to_hp2_I221F | CP-D3, RH + DS-Cav1 | 146-306 - ggsgg(Seq_1448) - 50-105 | GGSGG(Seq_1448) linker | 1144 |
| RSVF(+)THS_s_to_hp2_ds | CP-D3, RH + DS-Cav1 | 146-306 - ggsgg(Seq_1448) - 50-105 | GGSGG(Seq_1448) linker | 1145 |
| RSVF(+)THS_s_to_hp23 | CP-D3, RH + DS-Cav1 | 146-306 - ggsgg(Seq_1448) - 50-105 | GGSGG(Seq_1448) linker | 1146 |
| RSVF(+)THS_s_to_hp123 | CP-D3, RH + DS-Cav1 | 146-306 - ggsgg(Seq_1448) - 50-105 | GGSGG(Seq_1448) linker | 1147 |
| RSVF(+)THS_s_to A102C-A241C | CP-D3 + DS-Cav1 | 146-306 - ggsgg(Seq_1448) - 50-105 | GGSGG(Seq_1448) linker | 1148 |
| RSVF(+)THS_s_to_hp2 A102C-A241C | CP-D3, RH + DS-Cav1 | 146-306 - ggsgg(Seq_1448) - 50-105 | GGSGG(Seq_1448) linker | 1149 |
| RSVF(+)THS_s_to_hp12 A102C-A241C | CP-D3, RH + DS-Cav1 | 146-306 - ggsgg(Seq_1448) - 50-105 | GGSGG(Seq_1448) linker | 1150 |
| RSVF(+)THS_s_to_hp2_I221F A102C-A241C | CP-D3, RH + DS-Cav1 | 146-306 - ggsgg(Seq_1448) - 50-105 | GGSGG(Seq_1448) linker | 1151 |
| RSVF(+)THS_s_to_hp2_ds A102C-A241C | CP-D3, RH + DS-Cav1 | 146-306 - ggsgg(Seq_1448) - 50-105 | GGSGG(Seq_1448) linker | 1152 |
| RSVF(+)THS_s_to_hp23 A102C-A241C | CP-D3, RH + DS-Cav1 | 146-306 - ggsgg(Seq_1448) - 50-105 | GGSGG(Seq_1448) linker | 1153 |
| RSVF(+)THS_s_to_hp123 A102C-A241C | CP-D3, RH + DS-Cav1 | 146-306 - ggsgg(Seq_1448) - 50-105 | GGSGG(Seq_1448) linker | 1154 |
| RSVF(+)THS_s_to_hp1234 A102C-A241C | CP-D3, RH + DS-Cav1 | 146-306 - ggsgg(Seq_1448) - 50-105 | GGSGG(Seq_1448) linker | 1155 |
| E-CP_REM51-307_14mutDS-Cav1_THS | CP-D3, RH + DS-Cav1 | | GG linker | 1156 |
| E-RBD51-307_14mut_DS-Cav1_THS | CP-D3, RH + DS-Cav1 | | | 1157 |
| RSVF(+)THS_s_to_hp1234 A102C-A241C K196C-E60C | CP-D3, RH + DS-Cav1 | 146-306 - ggsgg(Seq_1448) - 50-105 | GGSGG(Seq_1448) linker | 1158 |
| E-CP_RBD51-307_14mutDS-Cav1_THS K196C-E60C | CP-D3, RH + DS-Cav1 | | GG linker | 1159 |
| E-RBD51-307_14mut_DS-Cav1_THS K196C-E60C | CP-D3, RH + DS-Cav1 | | | 1160 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| E-CP_RBD51-307_11mutDS-Cav1_THS | CP-D3, RH + DS-Cav1 | | GG linker | 1161 |
| E-RBD51-307_11mut_DS-Cav1_THS | CP-D3, RH + DS-Cav1 | | | 1162 |
| E-CP_RBD51-30711mut-K196C-E60C-DS-Cav1_THS | CP-D3, RH + DS-Cav1 | | GG linker | 1163 |
| E-RBD51-307_11mut-K196C-E60C-DS-Cav1_THS | CP-D3, RH + DS-Cav1 | | | 1164 |
| GSJnh1 | Truncated D3 | 46-310 | GG linker | 1165 |
| GSJnh2 | Truncated D3 | 46-310 | GG linker | 1166 |
| GSJnh3 | Truncated D3 | 51-305 | GG linker | 1167 |
| GSJnh4 | Truncated D3 | 51-305 | GSG linker | 1168 |
| Domain III with trimer (22) | | | | |
| RSVF(+)THS_s_to_foldon | CP-D3 + DS-Cav1 + Fd | 146-306 - ggsgg(Seq_1448) - 50-105 - ggsggsg (Seq_1445) - Fd | Glycine linkers and Fd | 1169 |
| RSVF(+)THS_s_to_hp2_foldon | CP-D3 + RH + DS-Cav1 + C-terminal Fd | 146-306 - ggsgg(Seq_1448) - 50-105 - ggsggsg (Seq_1445) - Fd | Glycine linkers and Fd | 1170 |
| RSVF(+)THS_s_to_hp12_foldon | CP-D3 + RH + DS-Cav1 + C-terminal Fd | 146-306 - ggsgg(Seq_1448) - 50-105 - ggsggsg (Seq_1445) - Fd | Glycine linkers and Fd | 1171 |
| RSVF(+)THS_s_to_hp2_foldon_I221F | CP-D3 + RH + DS-Cav1 + C-terminal Fd | 146-306 - ggsgg(Seq_1448) - 50-105 - ggsggsg (Seq_1445) - Fd | Glycine linkers and Fd | 1172 |
| RSVF(+)THS_s_to_hp2_foldon_ds | CP-D3 + RH + DS-Cav1 + C-terminal Fd | 146-306 - ggsgg(Seq_1448) - 50-105 - ggsggsg (Seq_1445) - Fd | Glycine linkers and Fd | 1173 |
| RSVF(+)THS_s_to_foldon A102C-A241C | CP-D3 + DS-Cav1 + Fd | 146-306 - ggsgg(Seq_1448) - 50-105 - ggsggsg (Seq_1445) - Fd | Glycine linkers and Fd | 1174 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| RSVF(+)THS_s_to_hp2_foldon A102C-A241C | CP-D3 + RH + DS-Cav1 + C-terminal Fd | 146-306 - ggsgg(Seq_1448) - 50-105 - ggsggsg (Seq_1445) - Fd | Glycine linkers and Fd | 1175 |
| RSVF(+)THS_s_to_hp12_foldon A102C-A241C | CP-D3 + RH + DS-Cav1 + C-terminal Fd | 146-306 - ggsgg(Seq_1448) - 50-105 - ggsggsg (Seq_1445) - Fd | Glycine linkers and Fd | 1176 |
| RSVF(+)THS_s_to_hp2_foldon_I221F A102C-A241C | CP-D3 + RH + DS-Cav1 + C-terminal Fd | 146-306 - ggsgg(Seq_1448) - 50-105 - ggsggsg (Seq_1445) - Fd | Glycine linkers and Fd | 1177 |
| RSVF(+)THS_s_to_hp2_foldon_ds A102C-A241C | CP-D3 + RH + DS-Cav1 + C-terminal Fd | 146-306 - ggsgg(Seq_1448) - 50-105 - ggsggsg (Seq_1445) - Fd | Glycine linkers and Fd | 1178 |
| GSJnhFd1 | Truncated D3 + Fd | | Fd | 1179 |
| GSJnhFd2 | Truncated D3 + Fd | | Fd | 1180 |
| MS_01 | D3 + C-terminal CCMPTD | 51-103, 146-307 | GGPGG(Seq_1451) linker turn, C-terminal CCMPTD | 1181 |
| MS_02 | D3 + C-terminal CCMPTD | 51-103, 146-307 | GGPGG(Seq_1451) turn, longer linker, C-terminal CCMPTD | 1182 |
| MS_03 | D3 + N-terminal CCMPTD | 51-103, 139-307 | GGPGG(Seq_1451) turn, C-terminal CCMPTD | 1183 |
| MS_04 | D3 + N-terminal CCMPTD | 51-103, 137-307 | GGPGG(Seq_1451) turn plus fusion peptide, C-terminal CCMPTD | 1184 |
| MS_05 | D3 + N-terminal CCMPTD | 51-103, 146-307 | GGPGG(Seq_1451) turn, C-terminal CCMPTD | 1185 |
| MS_06 | CP-D3, C-terminal MTQ-CC | 51-103, 146-307 | GGPGG(Seq_1451) turn, C-terminal MTQ-CC | 1186 |
| MS_07 | CP-D3, C-terminal MTQ-CC | 51-103, 146-307 | GGPGG(Seq_1451) turn, longer linker, C-terminal MTQ-CC | 1187 |
| MS_08 | CP-D3, N-terminal MTQ-CC | 51-103, 146-307 | GGPGG(Seq_1451) turn, C-terminal MTQ-CC | 1188 |
| MS_09 | CP-D3, N-terminal MTQ-CC | 51-103, 139-307 | GGPGG(Seq_1451) turn plus fusion peptide, C-terminal MTQ-CC | 1189 |
| MS_10 | CP-D3, N-terminal MTQ-CC | 51-103, 139-307 | GGPGG(Seq_1451) turn plus fusion peptide, C-terminal MTQ-CC | 1190 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| Tandem domain III (18) | | | | |
| GSJnh1-TWIN | TD3 | (47-307, 103GG147)GSG (47-307, 103GG147) | Glycine linkers | 1191 |
| GSJnh2-TWIN | TD3 | (47-307, 104GSG146)GSG (47-307, 104GSG146) | Glycine linkers | 1192 |
| GSJnh3-TWIN | TD3 | (51-305, 103GG147)GSG (51-305, 103GG147) | Glycine linkers | 1193 |
| GSJnh4-TWIN | TD3 | (51-305, 104GSG146)GSG (51-305, 104GSG146) | Glycine linkers | 1194 |
| GSJnh1-TWINLg | TD3 | (47-307, 103GG147)GGGSGGGG(47-307, 103GG147) | Glycine linkers | 1195 |
| GSJnh2-TWINLg | TD3 | (47-307, 104GSG146)GGGSGGGG(47-307, 104GSG146) | Glycine linkers | 1196 |
| GSJnh3-TWINLg | TD3 | (51-305, 103GG147)GGGSGGGG(51-305, 103GG147) | Glycine linkers | 1197 |
| GSJnh4-TWINLg | TD3 | (51-305, 104GSG146)GGGSGGGG(51-305, 104GSG146) | Glycine linkers | 1198 |
| LC-DH01 | CP-TD3 + long linker | 145-306, 52-96 | GGGSGGGSGGGSGGG (Seq_1452) linker | 1199 |
| LC-DH02 | CP-TD3 + long linker + DS | 145-306, 52-96 | GGGSGGGSGGGSGGG (Seq_1452) linker | 1200 |
| LC-DH03 | CP-TD3 + short linker | 145-306, 52-96 | GGGSGGGSGGG (Seq_1453) linker | 1201 |
| LC-DH04 | CP-TD3 + short linker | 145-306, 52-96 | GGGSGGGSGGG(Seq_1453) linker | 1202 |
| LC-DH05 | LM leader + CP-TD3 + short linker | 145-306, 52-96 | GGGSGGGSGGG(Seq_1453) linker | 1203 |
| LC-DH06 | LM leader + CP-TD3 + short linker + DS | 145-306, 52-96 | GGGSGGGSGGG (Seq_1453) linker | 1204 |
| LC-DH07 | LM leader + CP-TD3 + long linker | 145-306, 52-96 | GGGSGGGSGGGSGGG (Seq_1452) linker | 1205 |
| LC-DH08 | LM leader + CP-TD3 + long linker + DS | 145-306, 52-96 | GGGSGGGSGGGSGGG (Seq_1452) linker | 1206 |
| LC-DH09 | LM leader + CP-TD3 + long linker + Arg | 145-306, 52-96 | GGGSGGGSGGG(Seq_1453) linker | 1207 |
| LC-DH10 | LM leader + CP-TD3 + long linker + Arg + DS | 145-306, 52-96 | GGGSGGGSGGG(Seq_1453) linker | 1208 |

TABLE 20-continued

Minimal Site Ø immunogens (not on a protein nanoparticle)

| Name | Concept | Region of RSVF (residue #s) | scaffold or other added protein | SEQ ID NO |
|---|---|---|---|---|
| Tandem domain III with a trimer (10) | | | | |
| GSJnh1Fd-TWIN | TD3 + Fd | (47-307, 103GG147) GG-Fd-GG(47-307, 103GG147) | Glycine linkers | 1209 |
| GSJnh2Fd-TWIN | TD3 + Fd | (47-307, 104GSG146) GG-Fd-GG(47-307, 104GSG146) | Glycine linkers | 1210 |
| GSJnh3Fd-TWIN | TD3 + Fd | (51-305, 103GG147) GG-Fd-GG(51-305, 103GG147) | Glycine linkers | 1211 |
| GSJnh4Fd-TWIN | TD3 + Fd | (51-305, 104GSG146) GG-Fd-GG(51-305, 104GSG146) | Glycine linkers | 1212 |
| GSJnhFd3a TWIN | TD3 + Fd | (F1/GSG/F2/Fd/ F1/GSG/F2/Thbn/ H/S) | Glycine linkers | 1213 |
| GSJnhFd3b TWIN | TD3 + Fd | (H/S/Thbn/F1/GSG/ F2/Fd/F1/GSG/F2) | Glycine linkers | 1214 |
| GSJnh1-TWINGFd | TD3 + Fd | (47-307, 103Fd147)GSGGSG (47-307, 103GG147) | Glycine linkers | 1215 |
| GSJnh2-TWINGFd | TD3 + Fd | (47-307, 104Fd146)GSGGSG (47-307, 104GSG146) | Glycine linkers | 1216 |
| GSJnh1-TWINFdG | TD3 + Fd | (47-307, 103Fd147)GSGGSG (47-307, 103GG147) | Glycine linkers | 1217 |
| GSJnh2-TWINFdG | TD3 + Fd | (47-307, 104Fd146)GSGGSG (47-307, 104GSG146) | Glycine linkers | 1218 |

TABLE 21

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| Domain III on ferritin (45) | | | | | | |
| GSJnh1F | TD3 + Fer | Fer | 46-103 GG 147-310 | GG linker, C-terminal Fer | N-H8-Strep-GG-Thr-GGS | 1219 |
| GSJnh2F | TD3 + Fer | Fer | 46-104 GSG 146-310 | GSG linker, C-term. Fer | N-H8-Strep-GG-Thr-GGS | 1220 |
| GSJnh3F | TD3 + Fer | Fer | 51-103 GG 147-305 | GG linker, C-term. Fer | N-H8-Strep-GG-Thr-GGS | 1221 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| GSJnh4F | TD3 + Fer | Fer | 51-104 GSG 146-305 | GSG linker, C-term. Fer | N-H8-Strep-GG-Thr-GGS | 1222 |
| TK_01 | CP-SØ + DS + DPS | Dps | 59-97, 194-240 | Dps | N-H6-Thr | 1223 |
| TK_02 | CP-SØ + DS + DPS | Dps | 59-97, 194-240 | Dps | N-H6-Thr | 1224 |
| TK_03 | CP-SØ + DS + DPS | Dps | 59-97, 194-240 | Dps | N-H6-Thr | 1225 |
| TK_04 | CP-SØ + DS + DPS | Dps | 59-97, 194-240 | Dps | N-H6-Thr | 1226 |
| TK_05 | CP-SØ + CAV + DPS | Dps | 59-97, 194-240 | Dps | N-H6-Thr | 1227 |
| TK_06 | CP-SØ + CAV + DPS | Dps | 59-97, 194-240 | Dps | N-H6-Thr | 1228 |
| TK_07 | CP-SØ + CAV + DPS | Dps | 59-97, 194-240 | Dps | N-H6-Thr | 1229 |
| TK_08 | CP-SØ + CAV + DPS | Dps | 59-97, 194-240 | Dps | N-H6-Thr | 1230 |
| TK_09 | CP-SØ + CAV + DS + DPS | Dps | 59-97, 194-240 | Dps | N-H6-Thr | 1231 |
| TK_10 | CP-SØ + CAV + DS + DPS | Dps | 59-97, 194-240 | Dps | N-H6-Thr | 1232 |
| TK_11 | CP-SØ + CAV + DS + DPS | Dps | 59-97, 194-240 | Dps | N-H6-Thr | 1233 |
| TK_12 | CP-SØ + CAV + DS + DPS | Dps | 59-97, 194-240 | Dps | N-H6-Thr | 1234 |
| TK_13 | D3 + DS + CAV + Fer | Fer | 53-97, 148-305 | Fer | N-H6-Thr | 1235 |
| TK_14 | D3 + DS + CAV + Fer | Fer | 53-97, 148-306 | Fer | N-H6-Thr | 1236 |
| TK_15 | D3 + DS + CAV + Fer | Fer | 53-97, 148-307 | Fer | N-H6-Thr | 1237 |
| TK_16 | D3 + DS + CAV + Fer | Fer | 53-97, 148-308 | Fer | N-H6-Thr | 1238 |
| TK_17 | D3 + DS + CAV + Fer | Fer | 53-97, 148-309 | Fer | N-H6-Thr | 1239 |
| TK_18 | D3 + DS + CAV + Fer | Fer | 53-97, 148-310 | Fer | N-H6-Thr | 1240 |
| TK_19 | D3 + DS + CAV + Fer | Fer | 53-97, 148-311 | Fer | N-H6-Thr | 1241 |
| TK_20 | D3 + DS + CAV + Fer | Fer | 53-97, 148-312 | Fer | N-H6-Thr | 1242 |
| TK_21 | D3 + DS + CAV + Fer | Fer | 53-97, 148-313 | Fer | N-H6-Thr | 1243 |
| TK_22 | D3 + DS + CAV + Fer | Fer | 53-97, 148-314 | Fer | N-H6-Thr | 1244 |
| TK_23 | D3 + DS + CAV + Fer | Fer | 53-97, 148-315 | Fer | N-H6-Thr | 1245 |
| TK_24 | D3 + DS + CAV + Fer | Fer | 53-97, 148-316 | Fer | N-H6-Thr | 1246 |
| TK_25 | D3 + DS + CAV + Fer | Fer | 53-97, 148-317 | Fer | N-H6-Thr | 1247 |
| TK_26 | D3 + DS + CAV + Fer | Fer | 53-97, 148-318 | Fer | N-H6-Thr | 1248 |
| TK_27 | D3 + DS + CAV + Fer | Fer | 53-97, 148-319 | Fer | N-H6-Thr | 1249 |
| TK_28 | D3 + DS + CAV + Fer | Fer | 53-97, 148-320 | Fer | N-H6-Thr | 1250 |
| TK_29 | D3 + DS + RH + Fer | Fer | 53-104, 145-307 | Fer | N-H6-Thr | 1251 |
| TK_30 | D3 + DS + RH + Fer | Fer | 53-104, 145-307 | Fer | N-H6-Thr | 1252 |
| RSVF(+)THS_s_to + Fer_31n | CP-D3, RH + DS-Cav1 + Fer | Fer | 146-306 - ggsgg(Seq_1448) - 50-105 - sgg- Fer | Glycine linkers, Fer | N-Strep-H8-HRV3C | 1253 |

TABLE 21-continued

| Construct name | Concept | Part-icle | RSV F Region (residue #s) | scaffold or other added protein | His tag (N, I or C) | SEQ ID NO |
|---|---|---|---|---|---|---|
| Minimal site Ø immunogens on a protein nanoparticle. | | | | | | |
| RSVF(+)THS_s_to_hp2 + Fer_31n | CP-D3, RH + DS-Cav1 + Fer | Fer | 146-306 - ggsgg(Seq_1448) - 50-105 - sgg- Fer | Glycine linkers, Fer | N-Strep-H8-HRV3C | 1254 |
| RSVF(+)THS_s_to + Fer_51n | CP-D3, RH + DS-Cav1 + Fer | Fer | 146-306 - ggsgg(Seq_1448) - 50-105 - ggsgg(Seq_1448) - Fer | Glycine linkers, Fer | N-Strep-H8-HRV3C | 1255 |
| RSVF(+)THS_s_to_hp2 + Fer_51n | CP-D3, RH + DS-Cav1 + Fer | Fer | 146-306 - ggsgg(Seq_1448) - 50-105 - ggsgg(Seq_1448) - Fer | Glycine linkers, Fer | N-Strep-H8-HRV3C | 1256 |
| RSVF(+)THS_s_to_hp12 + Fer_51n | CP-D3, RH + DS-Cav1 + Fer | Fer | 146-306 - ggsgg(Seq_ 1448) - 50-105 ggsgg(Seq_1448) - Fer | Glycine linkers, Fer | N-Strep-H8-HRV3C | 1257 |
| RSVF(+)THS_s_to_hp2 + Fer_31n_I221F | CP-D3, RH + DS-Cav1 + Fer | Fer | 146-306 - ggsgg(Seq_1448) - 50-105 - sgg- Fer | Glycine linkers, Fer | N-Strep-H8-HRV3C | 1258 |
| RSVF(+)THS_s_to_hp2 + Fer_51n_I221F | CP-D3, RH + DS-Cav1 + Fer | Fer | 146-306 - ggsgg(Seq_1448) - 50-105 - ggsgg(Seq_1448) - Fer | Glycine linkers, Fer | N-Strep-H8-HRV3C | 1259 |
| MP1 | D3 + Cav + Fer | Fer | 50-306 GSG | Glycine linker, Fer | N-Strep-H8-Thr | 1260 |
| MP2 | D3 + Cav + Fer | Fer | 50-306 GGSGG(Seq_1448) | Glycine linker, Fer | N-Strep-H8-Thr | 1261 |
| MP10 | D3 + Fer | Fer | SC-GGSGG(Seq_1448) | Glycine linker, Fer | N-Strep-H8-Thr | 1262 |
| MP11 | D3 + Fer | Fer | SC-GGSGG(Seq_1448) | Glycine linker, Fer | N-Strep-H8-Thr | 1263 |
| Minimal epitope with trimer on ferritin (1) | | | | | | |
| MP9 | Minimal CP-SØ + ATCase trimerization domain + Fer | Fer | 56-76 G-ATCase-G-189-211GGSGG (Seq_1448) | Fer | N-Strep-H8-Thr | 1264 |
| Domain III with trimer on ferritin (4) | | | | | | |
| GSJnh1Fd-F | Truncated sc D3 + Fd + Fer | Fer | 46-310 | 103GG147, C-term. Fd-Fer | N-H8StrepGG-Thr-GGS | 1265 |
| GSJnh2Fd-F | Truncated sc D3 + Fd + Fer | Fer | 46-310 | 104GSG146, C-term. Fd-Fer | N-H8StrepGG-Thr-GGS | 1266 |
| GSJnh3Fd-F | Truncated sc D3 + Fd + Fer | Fer | 51-305 | 103GG147, C-term. Fd-Fer | C-term. H8StrepGG-Thr-GGS | 1267 |
| GSJnh4Fd-F | Truncated sc D3 + Fd + Fer | Fer | 51-305 | 104GSG146, C-term. Fd-Fer | C-term. H8StrepGG-Thr-GGS | 1268 |

TABLE 21-continued

| Construct name | Concept | Part-icle | RSV F Region (residue #s) | scaffold or other added protein | His tag (N, I or C) | SEQ ID NO |
|---|---|---|---|---|---|---|
| Minimal site Ø immunogens on a protein nanoparticle. | | | | | | |
| Minimal epitope on ferritin (10) | | | | | | |
| JCB_22 | CP-SØ + Fer | Fer | 60-94, 192-229 | PGG linker, Fer | N-H6-HRV3C | 1269 |
| JCB_23 | CP-SØ + Fer | Fer | 60-94, 192-229 | PGG linker, Fer | N-H6-HRV3C | 1270 |
| JCB_24 | CP-SØ + Fer | Fer | 60-94, 192-229 | PGG linker, Fer | N-H6-HRV3C | 1271 |
| JCB_25 | CP-SØ + Fer | Fer | 60-94, 192-229 | GSG linker, Fer | N-H6-HRV3C | 1272 |
| JCB_26 | CP-SØ + Fer | Fer | 60-94, 192-229 | GSG linker, Fer | N-H6-HRV3C | 1273 |
| JCB_27 | CP-SØ + Fer | Fer | 60-94, 192-229 | GSG linker, Fer | N-H6-HRV3C | 1274 |
| 2m0e-resurf1-Fer | Minimal SØ on a 2M0E + Fer | Fer | | Miz-1 zinc finger 6 (2M0E) fragment + Fer | N-Strep, H6, Thr | 1275 |
| 2m0e-resurf1-Fer | Minimal SØ on a 2M0E + Fer | Fer | | Miz-1 zinc finger 6 (2M0E) fragment + Fer | N-Strep, H6, Thr | 1276 |
| MP3 | CP-SØ + Fer | Fer | 56-97 GG 189-240 GSG | GG linker + Fer | N-Strep-H8-Thr | 1277 |
| MP4 | CP-SØ + Fer | Fer | same as MP3 with GGSGG(Seq_1448) | GGSGG (Seq_1448) linker + Fer | N-Strep-H8-Thr | 1278 |
| Minimal epitope on LS (2) | | | | | | |
| 2m0e-resurf1-LS | Minimal SØ on a 2M0E + LS | LS | | LS | C-term. Thr H6-strep | 1279 |
| 2m0e-resurf1-1y12 | Minimal SØ on a 2M0E + hcp1 | HCP1 | | HCP1 | C-term. Thr H6-strep | 1280 |
| Domain III on LS (2) | | | | | | |
| LS1-E-CP_RBD51-307_11mutDS-Cav1_THS | CP-D3, RH + DS-Cav1 + LS | LS | | LS | N-Strep, H6, Thr | 1281 |
| LS2-E-CP_RBD51-307_11mutDS-Cav1_THS | CP-D3, RH + DS-Cav1 + LS | LS | | LS | N-Strep, H6, Thr | 1282 |
| Domain III on hcp1 (4) | | | | | | |
| 1y12- E-CP_RBD51-307_11mutDS-Cav1_THS | CP-D3, RH + DS-Cav1 + hcp1 | HCP1 | | HCP1 | C-term. Thr H6-strep | 1283 |
| 1y12- E-RBD51-307_11mut_DS-Cav1_THS | CP-D3, RH + DS-Cav1 + hcp1 | HCP1 | | HCP1 | C-term. Thr H6-strep | 1284 |
| 1y12- E-CP_RBD51-307_14mutDS-Cav1_THS | CP-D3, RH + DS-Cav1 + hcp1 | HCP1 | | HCP1 | C-term. Thr H6-strep | 1285 |
| 1y12- E-RBD51-307_14mut_DS-Cav1_THS | CP-D3, RH + DS-Cav1 + hcp1 | HCP1 | | HCP1 | C-term. Thr H6-strep | 1286 |
| Monomers on ferritin (40) | | | | | | |
| JCB_1_GSGGSG_ferr | CP-SØ + CAV + Fer | Fer | 60-94, 192-232 | APGG linker + Fer | N-Strep-H8-Thr | 1287 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| JCB_2_GSGGSG_ferr | CP-SØ + CAV + Fer | Fer | 60-94, 192-232 | APGG linker, DS + Fer | N-Strep-H8-Thr | 1288 |
| JCB_5_GSGGSG_ferr | CP-SØ + CAV + Fer | Fer | 60-94, 192-232 | AGSG linker, DS + Fer | N-Strep-H8-Thr | 1289 |
| JCB_7_GSGGSG_ferr | CP-SØ + CAV + Fer | Fer | 60-94, 192-229 | GSG TABLE 21-continued Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| GSJnh4Fd-TWIN-Fer | TD3 with Fd | Fer | 51-305, 51-305 | Glycine linkers + T4 Fd + Fer | N - H8-Strep-Thr | 1309 |
| GSJnhFd2-Fer | TD3 with Fd | Fer | | Glycine linkers + T4 Fd + Fer | N- H8-Strep-Thr | 1310 |
| GSJnh2-TWINLg-Fer | TD3 | Fer | 47-307, 47-307 | Glycine linkers, Fer | N- H8-Strep-Thr | 1311 |
| GSJnh3-TWINLg-Fer | TD3 | Fer | 51-305, 51-305 | Glycine linkers, Fer | N- H8-Strep-Thr | 1312 |
| GSJnh4-TWINLg-Fer | TD3 | Fer | 51-305, 51-305 | Glycine linkers, Fer | N- H8-Strep-Thr | 1313 |
| RSVF(+)THS_s_to A102C-A241C_sgg_ferr | CP D3 + DS-Cav1 | Fer | 146-306 - ggsgg(Seq_1448) - 50-105 | Glycine linkers, Fer | N-Strep-H8-HRV3C | 1314 |
| RSVF(+)THS_s_to_foldon A102C-A241C_ggsggggsgg_ferr | CP D3 + DS-Cav1 + Fd | Fer | 146-306 - ggsgg(Seq_1448) - 50-105 - ggsggsg (Seq_1445) - Fd | Glycine linkers, Fer | N-Strep-H8-HRV3C | 1315 |
| RSVF(+)THS_s_to_hp12 A102C-A241C_ggsgg_ferr | CP D3 + EH + DS-Cav1 | Fer | 146-306 - ggsgg(Seq_1448) - 50-105 | Glycine linkers, Fer | N-Strep-H8-HRV3C | 1316 |
| RSVF(+)THS_s_to_hp123 A102C-A241C_ggsgg_ferr | CP D3 + EH + DS-Cav1 | Fer | 146-306 - ggsgg(Seq_1448) - 50-105 | Glycine linkers, Fer | N-Strep-H8-HRV3C | 1317 |
| RSVF(+)THS_s_to_hp1234 A102C-A241C_ggsgg_ferr | CP D3 + EH + DS-Cav1 | Fer | 146-306 - ggsgg(Seq_1448) - 50-105 | Glycine linkers, Fer | N-Strep-H8-HRV3C | 1318 |
| RSVF(+)THS_s_to_hp123_ ggsgg_ferr | CP D3 + EH + DS-Cav1 | Fer | 146-306 - ggsgg(Seq_1448) - 50-105 | Glycine linkers, Fer | N-Strep-H8-HRV3C | 1319 |
| RSVF(+)THS_s_to_hp2 A102C-A241C_sgg_ferr | CP D3 + EH + DS-Cav1 | Fer | 146-306 - ggsgg(Seq_1448) - 50-105 | Glycine linkers, Fer | N-Strep-H8-HRV3C | 1320 |
| RSVF(+)THS_s_to_hp23 A102C-A241C_sgg_ferr | CP D3 + EH + DS-Cav1 | Fer | 146-306 - ggsgg(Seq_1448) - 50-105 | Glycine linkers, Fer | N-Strep-H8-HRV3C | 1321 |
| RSVF(+)THS_s_to_hp23_ ggsgg_ferr | CP D3 + EH + DS-Cav1 | Fer | 146-306 - ggsgg(Seq_1448) - 50-105 | Glycine linkers, Fer | N-Strep-H8-HRV3C | 1322 |
| RSVF(+)THS_s_to_hp2_ds A102C-A241C_sgg_ferr | CP D3 + EH + DS-Cav1 | Fer | 146-306 - ggsgg(Seq_1448) - 50-105 | Glycine linkers, Fer | N-Strep-H8-HRV3C | 1323 |
| RSVF(+)THS_s_to_hp2_ ds_ggsgg_ferr | CP D3 + EH + DS-Cav1 | Fer | 146-306 - ggsgg- 50-105 | Glycine linkers, Fer | N-Strep-H8-HRV3C | 1324 |
| RSVF(+)THS_s_to_hp2_ I221F A102C-A241C_sgg_ferr | CP D3 + EH + DS-Cav1 | Fer | 146-306 - ggsgg(Seq_1448) - 50-105 | Glycine linkers, Fer | N-Strep-H8-HRV3C | 1325 |
| C-Trimer Fer: leader-Strep-HISx6-Thr-L1H1-K1-H2L2H3-GGSG | CP-SØ + Fer | Fer | | Glycine linker + Fer | N- Leader-Strep-HISx6-Thr | 1326 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| Monomers on LS (44) | | | | | | |
| JCB_1_GSGGSG_LS | CP-SØ + CAV + LS | LS | 60-94, 192-232 | APGG linker + LS | C-term. Thr, Strep, and H8 | 1327 |
| JCB_2_GSGGSG_LS | CP-SØ + CAV + LS | LS | 60-94, 192-232 | APGG linker, DS + LS | C-term. Thr, Strep, and H8 | 1328 |
| JCB_5_GSGGSG_LS | CP-SØ + CAV + LS | LS | 60-94, 192-232 | AGSG linker, DS + LS | C-term. Thr, Strep, and H8 | 1329 |
| JCB_7_GSGGSG_LS | CP-SØ + CAV + LS | LS | 60-94, 192-229 | GSG linker + LS | C-term. Thr, Strep, and H8 | 1330 |
| JCB_8_GSGGSG_LS | CP-SØ + CAV + LS | LS | 60-94, 192-229 | GSG linker, DS + LS | C-term. Thr, Strep, and H8 | 1331 |
| JCB_28_GSGGSG_LS | D3 + CAV + LS | LS | 53-96, 149-304 | Glycine linkers + LS | C-term. Thr, Strep, and H8 | 1332 |
| TZ_12r_GGSGGLS | CP-SØ + DS + CAV + charge + LS | LS | 192-242, 60-97 | Glycine linkers + LS | N-Strep-H8-Thr | 1333 |
| TZ_13r_GGSGG_LS | CP-SØ + DS + CAV + glycan + LS | LS | 192-242, 60-97 | Glycine linkers + LS | N-Strep-H8-Thr | 1334 |
| TZ_14r_GGSGSG_LS | CP-SØ + DS + CAV + glycan + LS | LS | 192-242, 60-97 | Glycine linkers + LS | N-Strep-H8-Thr | 1335 |
| Site_0_1chd_3_GYC_GGSGGSGGSGGSGGG_LS | CP-SØ + CAV + RH + DS + section of 1CHD scaffold + LS | LS | 60-95, 192-240 | CheB methylesterase fragment (1CHD) + LS | C-term. Thr-H6Strep | 1336 |
| JG_circ1_sol_ds_LS | CP-SØ + DS + LS | LS | 60-94, 193-237 | Glycine linkers + LS | C-Thr-His-Strep | 1337 |
| JG_2KN0_LS | CP-SØ + section of TENC1 (2KN0) scaffold + LS | LS | 60-75, 193-218 | Glycine linkers + TENC1 (2KN0) scaffold + Fer | C-Thr-His-Strep | 1338 |
| JG_Circ2_LS | CP-SØ + LS | LS | 60-75, 193-218 | Glycine linkers + LS | C-Thr-His-Strep | 1339 |
| JG_Circ2_sol_LS | CP-SØ + LS | LS | 60-75, 193-218 | Glycine linkers + LS | C-Thr-His-Strep | 1340 |
| GSJnh2-LS | Truncated sc D3 | LS | 46-310 | Glycine linkers, LS | N- H8-Strep-Thr | 1341 |
| GSJnh3-LS | Truncated sc D3 | LS | 51-305 | Glycine linkers, LS | N- H8-Strep-Thr | 1342 |
| GSJnh4-LS | Truncated sc D3 | LS | 51-305 | Glycine linkers, LS | N- H8-Strep-Thr | 1343 |
| GSJnh2-TWIN-LS | TD3 | LS | 47-307, 47-307 | Glycine linkers, LS | N- H8-Strep-Thr | 1344 |
| GSJnh3-TWIN-LS | TD3 | LS | 51-305, 51-305 | Glycine linkers, LS | N- H8-Strep-Thr | 1345 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| GSJnh4-TWIN-LS | TD3 | LS | 51-305, 51-305 | Glycine linkers, LS | N- H8-Strep-Thr | 1346 |
| GSJnh2Fd-TWIN-LS | TD3 with Fd | LS | 47-307, 47-307 | Glycine linkers + T4 Fd + LS | N- H8-Strep-Thr | 1347 |
| GSJnh4Fd-TWIN-LS | TD3 with Fd | LS | 51-305, 51-305 | Glycine linkers + T4 Fd + LS | N- H8-Strep-Thr | 1348 |
| GSJnhFd2-LS | TD3 with Fd | LS |  | Glycine linkers + T4 Fd + LS | N - H8-Strep-Thr | 1349 |
| GSJnh2-TWINLg-LS | TD3 | LS | 47-307, 47-307 | Glycine linkers, LS | N- H8-Strep-Thr | 1350 |
| GSJnh3-TWINLg-LS | TD3 | LS | 51-305, 51-305 | Glycine linkers, LS | N- H8-Strep-Thr | 1351 |
| GSJnh4-TWINLg-LS | TD3 | LS | 51-305, 51-305 | Glycine linkers, LS | N- H8-Strep-Thr | 1352 |
| RSVF(+)THS_s_to_gagg gsggsggsggg_ls | CP D3 + DS-Cav1 | LS | 146-306 - ggsgg(Seq_1448) - 50-105 | Glycine linkers, LS | N-Strep-H8-HRV3C | 1353 |
| RSVF(+)THS_s_to_hp2_ gagggsggsggsggg_ls | CP D3 + EH + DS-Cav1 | LS | 146-306 - ggsgg(Seq_1448) - 50-105 | Glycine linkers, LS | N-Strep-H8-HRV3C | 1354 |
| RSVF(+)THS_s_to_hp12_ gagggsggsggsggg_ls | CP D3 + EH + DS-Cav1 | LS | 146-306 - ggsgg(Seq_1448) - 50-105 | Glycine linkers, LS | N-Strep-H8-HRV3C | 1355 |
| RSVF(+)THS_s_to_hp2_ I221F_gagggsggsggsgg g_ls | CP D3 + EH + DS-Cav1 | LS | 146-306 - ggsgg(Seq_1448) - 50-105 | Glycine linkers, LS | N-Strep-H8-HRV3C | 1356 |
| RSVF(+)THS_s_to A102C-A241C_gagggsggsggsggg_ls | CP D3 + DS-Cav1 | LS | 146-306 - ggsgg(Seq_1448) - 50-105 | Glycine linkers, LS | N-Strep-H8-HRV3C | 1357 |
| RSVF(+)THS_s_to_hp12 A102C-A241C_gagggsggsggsggg_ls | CP D3 + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1358 |
| RSVF(+)THS_s_to_hp123_ gagggsggsggsggg_ls | CP D3 + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1359 |
| RSVF(+)THS_s_to_hp123 A102C-A241C_gagggsggsggsggg_ls | CP D3 + EH + DS-Cav1 | LS | 146-306 - ggsgg(Seq_1448) - 50-105 | Glycine linkers, LS | N-Strep-H8-HRV3C | 1360 |
| RSVF(+)THS_s_to_hp1234 A102C-A241C_gagggsggsggsggg_ls | CP D3 + EH + DS-Cav1 | LS | 146-306 - ggsgg(Seq_1448) - 50-105 | Glycine linkers, LS | N-Strep-H8-HRV3C | 1361 |
| RSVF(+)THS_s_to_hp2 A102C-A241C_gagggsggsggsggg_ls | CP D3 + EH + DS-Cav1 | LS | 146-306 - ggsgg(Seq_1448) - 50-105 | Glycine linkers, LS | N-Strep-H8-HRV3C | 1362 |
| RSVF(+)THS_s_to_hp2_ ds_gagggsggsggsggg_ls | CP D3 + EH + DS-Cav1 | LS | 146-306 - ggsgg(Seq_1448) - 50-105 | Glycine linkers, LS | N-Strep-H8-HRV3C | 1363 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| RSVF(+)THS_s_to_hp2_ds A102C-A241C_gagggsggsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1364 |
| RSVF(+)THS_s_to_hp2_I221F A102C-A241C_gagggsggsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1365 |
| RSVF(+)THS_s_to_hp23_ gagggsggsggsggg_ls | CP D3 + EH + DS-Cav1 | LS | 146-306 - ggsgg(Seq_1448) - 50-105 | Glycine linkers, LS | N-Strep-H8-HRV3C | 1366 |
| RSVF(+)THS_s_to_hp23 A102C-A241C_gagggsggsggsggg_ls | CP D3 + EH + DS-Cav1 | LS | 146-306 - ggsgg(Seq_1448) - 50-105 | Glycine linkers, LS | N-Strep-H8-HRV3C | 1367 |
| C-Trimer LS: Strep-HISx6-Thr-L1H1-K1-H2L2H3-GGSGGGSG | CP-SØ + LS | LS | | Glycine linker + LS | N- leader-Strep-HISx6-Thr | 1368 |
| C-Trimer LS: leader-L1H1-K1-H2L2H3-GGSGGGSG-LS-Thr-HISx6-Strep: | CP-SØ + LS | LS | | Glycine linker + LS | C-Leader-Thr-H6-Strep | 1369 |
| Trimers on ferritin (30) | | | | | | |
| JCB_13_GSGGGSG_ferr | CP-SØ + CAV + DS + GCN4 + Fer | Fer | 60-94, 192-232 | APGG linker, GCN4, inter-DS + Fer | N-Strep-H8-Thr | 1370 |
| JCB_19_GSGGSG_ferr | CP-SØ + CAV + DS + GCN4 + Fer | Fer | 60-94, 192-229 | GSG linker, GCN4, inter-DS + Fer | N-Strep-H8-Thr | 1371 |
| TZ_05_GGSG_ferr | CP-SØ + interchain DS + CAV + charge + Fer | Fer | 192-242, 60-97 | Glycine linkers, Fer | N-Strep-H8-Thr | 1372 |
| TZ_08r_GGSG_ferr | CP-SØ + interchain DS + CAV + glycan + Fer | Fer | 192-242, 60-97 | Glycine linkers, Fer | N-Strep-H8-Thr | 1373 |
| TZ_15_GGSG_3Hferr | CP-SØ + interchain DS + CXVIII + Fer | Fer | 58-97, 192-242 | Glycine linkers + CXVIII + Fer | N-Strep-H8-Thr | 1374 |
| TZ_16_GGSG_3Hferr | CP-SØ + interchain DS + CAV + CXVIII + Fer | Fer | 58-97, 192-242 | Glycine linkers + CXVIII + Fer | N-Strep-H8-Thr | 1375 |
| TZ_17_GGSGSG_3Hferr | CP-SØ + interchain DS + CAV + CXVIII + Fer | Fer | 58-97, 192-242 | Glycine linkers + CXVIII + Fer | N-Strep-H8-Thr | 1376 |
| TZ_19_GGSGSGG_3Hferr | CP-SØ + interchain DS + CAV + charge + glycan + CXVIII + Fer | Fer | 58-97, 192-242 | Glycine linkers + CXVIII + Fer | N-Strep-H8-Thr | 1377 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| TZ_19_GGSGG_ferr | CP-SØ + interchain DS + CAV + charge + glycan + Fer | Fer | 58-97, 192-242 | Glycine linkers, Fer | N-Strep-H8-Thr | 1378 |
| TZ_20_GGSGSGG_3Hferr | CP-SØ + DS + CAV + charge + glycan + CXVIII + Fer | Fer | 58-97, 192-242 | Glycine linkers + CXVIII + Fer | N-Strep-H8-Thr | 1379 |
| MS_03_GGGSSGSGGGSSGG GSSGGGS_Ferr | D3 + N-term. CCMPTD + Fer | Fer | 51-103, 139-307 | Glycine linkers, Fer | N-Strep-H8-Thr | 1380 |
| MS_05_GGGSSGSGGGSSGG GSSGGGS_Ferr | D3 + N-term. CCMPTD + Fer | Fer | 51-103, 146-307 | Glycine linkers, Fer | N-Strep-H8-Thr | 1381 |
| MS_07_GSGGGSSGSGGGSSGGGSSG GGS_Ferr | CP-D3, C-term. MTQ-CC + Fer | Fer | 51-103, 146-307 | Glycine linkers, Fer | N-Strep-H8-Thr | 1382 |
| MS_08_GGGSSGSGGGSSGGGSSGGG S_Ferr | CP-D3, C-term. MTQ-CC + Fer | Fer | 51-103, 146-307 | Glycine linkers, Fer | N-Strep-H8-Thr | 1383 |
| MS_09_GGGSSGSGGGSSGG GSSGGGS_Ferr | CP-D3, C-term. MTQ-CC + Fer | Fer | 51-103, 139-307 | Glycine linkers, Fer | N-Strep-H8-Thr | 1384 |
| GSJnh2-Fer A74C E218C | Truncated sc D3, interchain DS | Fer | 46-310 | Glycine linkers, Fer | N- H8-Strep-Thr | 1385 |
| GSJnh3-Fer A74C E218C | Truncated sc D3, interchain DS | Fer | 51-305 | Glycine linkers, Fer | N- H8-Strep-Thr | 1386 |
| GSJnh4-Fer A74C E218C | Truncated sc D3, interchain DS | Fer | 51-305 | Glycine linkers, Fer | N- H8-Strep-Thr | 1387 |
| GSJnh4-TWIN-Fer A74C E218C | TD3, interchain DS | Fer | 51-305, 51-305 | Glycine linkers, Fer | N- H8-Strep-Thr | 1388 |
| RSVF(+)THS_s_to_fold on_ggsggggsgg_ferr | CP D3 + DS-Cav1 + Fd | Fer | 146-306 - ggsgg(Seq_1448) - 50-105 - ggsggsg (Seq_1445) - Fd | Glycine linkers, Fer | N-Strep-H8-HRV3C | 1389 |
| RSVF(+)THS_s_to_hp12_foldon A102C-A241C_ggsggggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1390 |
| RSVF(+)THS_s_to_hp12_foldon_ggsggggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1391 |
| RSVF(+)THS_s_to_hp2_foldon A102C-A241C_ggsggggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1392 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| RSVF(+)THS_s_to_hp2_foldon_ds A102C-A241C_ggsgggsgg_ferr | CP D3 + EH + DS-Cav1 | Fer | 146-306 - ggsgg(Seq_1448) - 50-105 | Glycine linkers, Fer | N-Strep-H8-HRV3C | 1393 |
| RSVF(+)THS_s_to_hp2_foldon_ds_ggsgggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1394 |
| RSVF(+)THS_s_to_hp2_foldon_ggsgggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1395 |
| RSVF(+)THS_s_to_hp2_foldon_I221F A102C-A241C_ggsgggsgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1396 |
| RSVF(+)THS_s_to_hp2_foldon_I221F_ggsgggg sgg_ferr | CP D3 + EH + DS-Cav1 + Fd | Fer | 146-306 - ggsgg(Seq_1448) - 50-105 - ggsggsg (Seq_1445) - Fd | Glycine linkers + T4 Fd + Fer | N-Strep-H8-HRV3C | 1397 |
| C-Trimer 1GQ3-Fer: leader-Strep-HISx6-Thr-L1H1-K1-H2L2H3-GGSGGGSG-1GQ3-GGSGGGSGGGSGGGSG-Fer | CP-SØ + C-term. ATCase + Fer | Fer | | Glycine linkers + ATCase (1GQ3) + Fer | N- Leader-Strep-HISx6-Thr | 1398 |
| C-Trimer 1GQ3-Fer: leader-Strep-HISx6-Thr-L1H1-K1-H2L2H3-GGSGGGSG-1GQ3-GGSGGGSGGGSGGGSGGGSG-Fer | CP-SØ + C-term. ATCase + Fer | Fer | | Glycine linkers + ATCase (1GQ3) + Fer | N- Leader-Strep-HISx6-Thr | 1399 |
| Trimers on LS (30) | | | | | | |
| JCB_13_GSGGGSG_LS | CP-SØ + CAV + DS + GCN4 + LS | LS | 60-94, 192-232 | APGG linker, GCN4, inter-DS + LS | C-term. Thr, Strep, and H8 | 1400 |
| JCB_19_GSGGSG_LS | SØ + CAV + DS + GCN4 + LS | LS | 60-94, 192-232 | GSG linker, GCN4, inter-DS + LS | C-term. Thr, Strep, and H8 | 1401 |
| TZ_05_GGSGGG_LS | CP-SØ + DS + CAV + charge + LS | LS | 192-242, 60-97 | Glycine linkers + LS | N-Strep-H8-Thr | 1402 |
| TZ_08r_GGSGGG_LS | CP-SØ + DS + CAV + glycan + LS | LS | 192-242, 60-97 | Glycine linkers + LS | N-Strep-H8-Thr | 1403 |
| TZ_09r_GGSGGG_LS | CP-SØ + DS + CAV + glycan + LS | LS | 192-242, 60-97 | Glycine linkers + LS | N-Strep-H8-Thr | 1404 |
| TZ_15_GGG-LS | CP-SØ + DS + LS | LS | 58-97, 192-242 | Glycine linkers + LS | N-Strep-H8-Thr | 1405 |
| TZ_16_GGG_LS | CP-SØ + DS + CAV + LS | LS | 58-97, 192-242 | Glycine linkers + LS | N-Strep-H8-Thr | 1406 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| TZ_17_GGG_LS | CP-SØ + DS + CAV + LS | LS | 58-97, 192-242 | Glycine linkers + LS | N-Strep-H8-Thr | 1407 |
| TZ_19_GGG_LS | CP-SØ + DS + CAV + charge + glycan + LS | LS | 58-97, 192-242 | Glycine linkers + LS | N-Strep-H8-Thr | 1408 |
| TZ_20_GGG_LS | CP-SØ + DS + CAV + charge + glycan + LS | LS | 58-97, 192-242 | Glycine linkers + LS | N-Strep-H8-Thr | 1409 |
| MS_03_GGGSSGSGGGSSGGGSSGGGS_LS | D3 + N-term. CCMPTD + LS | LS | 51-103, 139-307 | Glycine linkers + CCMPTD + LS | N-Strep-H8-Thr | 1410 |
| MS_05_GGGSSGSGGGSSGGSSGGGS_LS | D3 + N-term. CCMPTD + LS | LS | 51-103, 146-307 | Glycine linkers + CCMPTD + LS | N-Strep-H8-Thr | 1411 |
| MS_07_GSGGGSSGSGGGGSSGGGSSGGGS_LS | CP-D3, C-term. MTQ-CC + LS | LS | 51-103, 146-307 | Glycine linkers + CCMPTD + LS | N-Strep-H8-Thr | 1412 |
| MS_08_GGGSSGSGGGGSSGGGGSSGGGS_LS | CP-D3, C-term. MTQ-CC + LS | LS | 51-103, 146-307 | Glycine linkers + CCMPTD + LS | N-Strep-H8-Thr | 1413 |
| MS_09_GGGSSGSGGGSSGGGSSGGGS_LS | CP-D3, C-term. MTQ-CC + LS | LS | 51-103, 139-307 | Glycine linkers + CCMPTD + LS | N-Strep-H8-Thrombin | 1414 |
| RSVF(+)THS_s_to_foldon_gagggsggsggsggg_ls | CP D3 + EH + DS-Cav1 | LS | 146-306 - ggsgg(Seq_1448) - 50-105 + Fd | Glycine linkers, LS | N-Strep-H8-HRV3C | 1415 |
| RSVF(+)THS_s_to_foldon A102C-A241C_gagggsggsggsggg_ls | CP D3 + EH + DS-Cav1 | LS | 146-306 - ggsgg(Seq_1448) - 50-105 + Fd | Glycine linkers, LS | N-Strep-H8-HRV3C | 1416 |
| RSVF(+)THS_s_to_hp12_foldon_ gagggsggsggsggg_ls | CP D3 + EH + DS-Cav1 | LS | 146-306 - ggsgg(Seq_1448) - 50-105 + Fd | Glycine linkers, LS | N-Strep-H8-HRV3C | 1417 |
| RSVF(+)THS_s_to_hp12_foldon A102C-A241C_gagggsggsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1418 |
| RSVF(+)THS_s_to_hp2_foldon_ gagggsggsggsgg gg_ls | CP D3 + EH + DS-Cav1 | LS | 146-306 - ggsgg(Seq_1448) - 50-105 + Fd | Glycine linkers, LS | N-Strep-H8-HRV3C | 1419 |
| RSVF(+)THS_s_to_hp2_foldon A102C-A241C_gagggsggsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1420 |
| RSVF(+)THS_s_to_hp2_foldon_ds_gagggsggsg gsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1421 |

TABLE 21-continued

Minimal site Ø immunogens on a protein nanoparticle.

| Construct name | Concept | Particle | RSV F Region (residue #s) | scaffold or other added protein | His tag (N, I or C) | SEQ ID NO |
|---|---|---|---|---|---|---|
| RSVF(+)THS_s_to_hp2_foldon_ds_A102C-A241C_gagggsggsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1422 |
| RSVF(+)THS_s_to_hp2_foldon_I221F_gagggsg gsggsggg_ls | CP D3 + EH + DS-Cav1 + Fd | LS | 146-306 - ggsgg(Seq_1448) - 50-105 - ggsggsg (Seq_1445) - Fd | Glycine linkers + T4 Fd + LS | N-Strep-H8-HRV3C | 1423 |
| RSVF(+)THS_s_to_hp2_foldon_I221F_A102C-A241C_gagggsggsggsggg_ls | CP D3 + EH + DS-Cav1 + Fd | LS | 146-306 - ggsgg(Seq_1448) - 50-105 + Fd | Glycine linkers, LS | N-Strep-H8-HRV3C | 1424 |
| C-Trimer 1GQ3-LS_60mer: leader-Strep-HISx6-Thr-L1H1-K1-H2L2H3-GGSGGGSG-1GQ3-GGSGGGSGGGSGGGSG-LS | CP-SØ + C-term. ATCase + LS | LS | | Glycine linkers + E coli ATCase (1GQ3) + LS | N- Leader-Strep-HISx6-Thr | 1425 |
| C-Trimer 1GQ3-LS_60mer: leader-Strep-HISx6-Thr-L1H1-K1-H2L2H3-GGSGGGSG-1GQ3-GGSGGGSGGGSGGGSGGGSG-LS | CP-SØ + C-term. ATCase + LS | LS | | Glycine linkers + E coli ATCase (1GQ3) + LS | N- Leader-Strep-HISx6-Thr | 1426 |
| C-Trimer 1GQ3-LS_60mer: leader-L1H1-K1-H2L2H3-GGSGGGSG-1GQ3-GGSGGGSGGGSGGGSG-LS-Thr-HISx6-Strep | CP-SØ + C-term. ATCase + LS | LS | | Glycine linkers + E coli ATCase (1GQ3) + LS | C-Leader-Thr-H6-Strep | 1427 |
| C-Trimer 1GQ3-LS_60mer: leader-L1H1-K1-H2L2H3-GGSGGGSG-1GQ3-GGSGGGSGGGSGGGSGGGSG-LS-Thr-HISx6-Strep | CP-SØ + C-term. ATCase + LS | LS | | Glycine linkers + E coli ATCase (1GQ3) + LS | C-Leader-Thr-H6-Strep | 1428 |

Example 15

Immunogenicity of Prefusion Stabilized F Protein

A series of assays (in addition to those provided above) were performed to illustrate the immunogenicity of the recombinant RSV F proteins provided herein that are stabilized in a prefusion conformation. The results show that the provided recombinant RSV F proteins stabilized in a prefusion conformation can be used to induce an immune response in multiple animal models, and further that induction of this immune response protects against future viral challenge.

Unless indicated otherwise, in FIGS. 73-84, and in this example, reference is made to the following recombinant RSV F proteins:
DS (Subtype A)=RSV A2 F(+)FdTHS S155C, S290C (SEQ ID NO: 185)
DS (Subtype B)=RSV B18537 F(+)FdTHS S155C, S290C (SEQ ID NO: 1479)
DS-Cav1 (Subtype A)=RSV A2 F(+)FdTHS S155C, S290C, S190F, V207L (SEQ ID NO: 371)
DS-Cav1 (Subtype B)=RSV B18537 F(+)FdTHS S155C, S290C, S190F, V207L (SEQ ID NO: 372)
Postfusion F (Subtype A)=RSV A2 F(+) dFPTHS FIG. 73 illustrates that, using Ribi as adjuvant, a single chain version of DS-Cav1 presented in the context of a ferritin nanoparticle given IM elicits a small but detectable neutralizing antibody response after 2 weeks in rhesus macaques after a single dose. Based on these small but detectable responses after one dose it is expected that after boosting with a second dose a significant neutralizing antibody response will be induced. This would be consistent with the immunogenicity of 2 mcg of cleaved DS stabilized prefusion F trimer presented on a ferritin nanoparticle formulated with Ribi after 2 doses in mice, discussed below.

As illustrated in FIG. 74, mice (CB6F1/J) an immune response to the DS version of stabilized prefusion is induced in mice immunized with 20 mcg of DS F in 50 mcg of poly ICLC on weeks 0 and 3. Neutralizing activity was maintained at a high level in DS immunized mice for more than 12 weeks.

As illustrated in FIG. 75, immunization with DS (Subtype A)=RSV A2 F(+)FdTHS S155C, S290C (SEQ ID NO: 185) can prevent RSV infection in an animal model. Mice were immunized IM with the DS version of the stabilized F protein (SEQ ID NO: 185) at week 0 and week 3. Mice were challenged intranasally with 10e7 pfu of homologous RSV A2 virus on week 19, four months after the last vaccination. On day 5 lungs and noses were removed to measure virus load in tissue. The results show that mice immunized with the DS version of prefusion F had no detectable virus in lung or nose.

Further, the mice administered DS (Subtype A)=RSV A2 F(+)FdTHS S155C, S290C (SEQ ID NO: 185) did not undergo a Type 2 cytokine response to the immunogen (FIG. 76). Cytokine content was measured in lung and nose supernatants on day 5 following initial immunization with control (PBS), wild-type RSV (RSV), formalin inactivated RSV (FIRSV), DS (SEQ ID NO: 185; "pre-fusion F), or a stabilized post fusion F construct (post-fusion F). Mice undergoing primary infection had significant levels of IFN-gamma and MIP-1alpha as expected. FI-RSV immunized mice had significant levels of type 2 cytokines (IL-4, IL-5, and IL-13) and cytokines associated with epithelial damage (IL-6) typical of responses associated with vaccine-enhanced disease. Mice immunized with prefusion F (DS) had a modest level of IFN-gamma and IL-10 associated with an effective and regulated response and no illness or weight loss.

The neutralization activity of serum from non-human primate models immunized with the recombinant RSV F DSCav1 protein (SEQ ID NO: 371) was assayed over the course of a three-dose immunization (FIG. 77). Rhesus macaques, 4 per group, were immunized twice at 0 and 4 weeks with 50 mcg IM with either DS-Cav1 prefusion F (SEQ ID NO: 371) or postfusion F based on subtype A sequence and formulated with poly ICLC. On week 26, both groups were boosted with 50 mcg IM of DS-Cav1 prefusion F formulated with poly ICLC. After 2 doses of DS-Cav1, significant neutralizing activity is induced and sustained above the protective threshold for more than 5 months. Postfusion F was immunogenic and induced detectable neutralizing activity after 2 doses, but was only transiently above the protective threshold. Boosting the postfusion F group with a $3^{rd}$ dose of DS-Cav1 stabilized prefusion F resulted in a rise in neutralizing activity above that achieved after the $2^{nd}$ dose. After the $3^{rd}$ dose neutralizing activity against the homologous subtype A was stably maintained for over 10 weeks as highlighted in the red boxed areas.

To demonstrate that the DSCav1 construct can be formulated with Alum, purified DSCav1 (SEQ ID NO: 371) was mixed with Alum hydroxide gel or Alum phosphate gel at various ratios. BALB/c mice were immunized IM with 10 mcg of DS-Cav1 version of stabilize prefusion F formulated with alum (either aluminum hydroxide gel or aluminum phosphate gel) at 0 and 3 weeks. The protein:alum wt:wt ratios were varied between 1:1 and 1:10. All formulations were immunogenic (FIG. 78). In addition, use of Alum as an adjuvant for DSCav1 immunization was demonstrated in a non-human primate model (FIG. 79). Rhesus macaques were immunized at week 0, 4, and 26 with purified DS protein (SEQ ID NO: 185). The week 0 and 4 injections were comprised of the DS version of stabilized RSV prefusion F (50 mcg) formulated in poly ICLC. The week 26 boost was 50 mcg of the DS prefusion stabilized F formulated in aluminum phosphate gel. Therefore alum is an effective adjuvant for the stabilized prefusion F in NHP.

To show that another immunization protocol is effective for inducing an effective immune response with DSCav1, mice were immunized with a gene-based vector expressing DSCav1, and the resulting immune response to RSV F was evaluated (FIG. 80). CB6F15 mice were immunized with a recombinant adenovirus serotype 5 vector expressing the wild-type version of F at 0 and 3 weeks or were immunized at week 0 with rAd5 expressing the DS-Cav1 version of preF membrane anchored (non-secreted) and boosted with 10 mcg of DS-Cav1 formulated in alum at week 3. rAd5-preF primed mice boosted with DS-Cav1 in alum produced as much neutralizing antibody as mice given two doses of protein only indicating that prefusion F delivered by a gene-based vector is immunogenic and can prime for a subsequent protein boost.

Additionally, the DSCav1 protein was effective for boosting an immune response to wild-type (WT) RSV F (FIG. 81). Non-human primates primed with recombinant adenovirus vectors expressing WT versions of RSV F (subtype A) more than 2 years before boost, were boosted with a single 50 mcg dose of DS-Cav1 subtype A or subtype B formulated in alum. Two weeks after boosting neutralizing activity was significantly increased by both subtype A and B DS-Cav1 proteins (FIGS. 81-82).

To demonstrate the cross-subtype effectiveness of the DS (S155C, S290C) version of stabilized F, CB6F1/J mice were immunized IM with 10 mcg of DS formulated in Ribi at week 0 and week 3 (FIG. 83). Neutralizing antibody was induced by both A (SEQ ID NO: 185) and B (SEQ ID NO: 1479) subtype proteins against both subtype A and B viruses. The group receiving both A and B received a total of 20 mcg of protein.

FIG. 84 illustrates that altering the glycosylation of the RSV F protein reduces its immunogenicity. BALB/c mice were immunized with 10 mcg of the DS version of stabilized prefusion F formulated in poly IC at weeks 0 and 3. The F constructs were treated with glycosidases or mutant versions were made to remove glycosylation sites at N27 and N70. The F protein could not be produced if the N500 glycosylation was mutated suggesting that glycosylation at that site is required for expression. Neutralizing activity was detected at week 5 (solid bars) and week 7 (hatched bars) in mice immunized by any of the glycosylation variants of F. However, altering glycosylation appeared to reduce immunogenicity compared to the original DS version of stabilized prefusion F. ****=P<0.0001.

It will be apparent that the precise details of the methods or compositions described may be varied or modified without departing from the spirit of the described embodiments. We claim all such modifications and variations that fall within the scope and spirit of the claims below.

SEQUENCE LISTING (1479 sequences)

SEQ ID NO: 1 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKADVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 2 - protein, 573 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFS

SEQ ID NO: 3 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 4 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 5 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKEQLSGINNIAFSN

SEQ ID NO: 6 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYFKARSTPVTLSKDQLSGINNIAFSN

SEQ ID NO: 7 - protein, 574 aa, respiratory syncytial virus
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 8 - protein, 574 aa, respiratory syncytial virus
  misc_feature (91)..(91): Xaa can be any naturally occurring amino acid
  misc_feature (363)..(363): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVXELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSXRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 9 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNNNVTLSNKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 10 - protein, 574 aa, respiratory syncytial virus
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 11 - protein, 574 aa, respiratory syncytial virus
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 12 - protein, 574 aa, respiratory syncytial virus
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 13 - protein, 574 aa, respiratory syncytial virus
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 14 - protein, 569 aa, respiratory syncytial virus
MDLPILKTNAITAILAVVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINN

SEQ ID NO: 15 - protein, 574 aa, respiratory syncytial virus
MDLPILKTKAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 16 - protein, 574 aa, respiratory syncytial virus
MELPILKTNAITTILTAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 17 - protein, 574 aa, respiratory syncytial virus
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 18 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 19 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTVINDQLSGINNIAFSN

SEQ ID NO: 20 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLCVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 21 - protein, 574 aa, respiratory syncytial virus
  misc_feature (272)..(272): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKXLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 22 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 23 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 24 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 25 - protein, 574 aa, respiratory syncytial virus
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 26 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 27 - protein, 573 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 28 - protein, 574 aa, respiratory syncytial virus
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMFNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 29 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPVVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 30 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTVSKDQLSGINNIAFSN

SEQ ID NO: 31 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSS

SEQ ID NO: 32 - protein, 574 aa, respiratory syncytial virus
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 33 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 34 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 35 - protein, 573 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 36 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKYDELLHNVNAGKSTTNIMITTIIIVIIVILLSLIAVGLLLYCKARSTPVTLSKDQLSGINNIAFSN

SEQ ID NO: 37 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 38 - protein, 574 aa, respiratory syncytial virus
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 39 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 40 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 41 - protein, 574 aa, respiratory syncytial virus
  misc_feature (32)..(32): Xaa can be any naturally occurring amino acid
MELPILKTNAITTILAAVTLCFASSQNITEEXYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 42 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 43 - protein, 574 aa, respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 44 - protein, 574 aa, respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNKKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 45 - protein, 574 aa, respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTSIMITTIIIVIIVILLSLIAVGLLLYCKARSTPVTLSKDQLSGINNIAFSN

SEQ ID NO: 46 - protein, 574 aa, respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 47 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 48 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPFDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 49 - protein, 574 aa, respiratory syncytial virus
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 50 - protein, 574 aa, respiratory syncytial virus
MELPILKTNAITTILAAVTLCFASSQNITEEFYQSTCSAVSKGYLSALRTGWYTSVITIELSTIKENKCNGTDAKGKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKARSTPVTLSKDQLSGINNIAFSS

SEQ ID NO: 51 - protein, 574 aa, respiratory syncytial virus
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 52 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 53 - protein, 574 aa, respiratory syncytial virus
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 54 - protein, 565 aa, respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQTVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIDQSLAFIRKSDELLHNVNAGKSTTNIMITTIIIVIIVILLALIAVGLLLYCKARSTPVTLSKDQLR

SEQ ID NO: 55 - protein, 574 aa, respiratory syncytial virus
MELPILKANAISTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 56 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 57 - protein, 569 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 58 - protein, 569 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVITVILLALIAVGLLLYCKARSTPVTLSKDQLSGINN

SEQ ID NO: 59 - protein, 569 aa, respiratory syncytial virus
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 60 - protein, 569 aa, respiratory syncytial virus
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 61 - protein, 569 aa, respiratory syncytial virus
MELPILKTNAITTILAAVTLCFASSQNITEEFYQSTCSAVSKGYLSALRTGWYTSVIAIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 62 - protein, 569 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPISTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 63 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKARSTPVTLSKDQLSGINNIAFSN

SEQ ID NO: 64 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 65 - protein, 574 aa, respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 66 - protein, 574 aa, respiratory syncytial virus
MELPILKTNAITTILAAVTLCFSSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 67 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 68 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGTAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 69 - protein, 574 aa, respiratory syncytial virus
  misc_feature (292)..(292): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIXKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 70 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISLVNEKINQSLAFIRKSDELLHNVNAGKSTTNIMITTIIIVIIVILLALIAVGLLLYCKARSTPVTLSKDQLSGINNIAFSN

SEQ ID NO: 71 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSILNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 72 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPSANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 73 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKVGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 74 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 75 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 76 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 77 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPTANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 78 - protein, 569 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 79 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 80 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 81 - protein, 574 aa, respiratory syncytial virus
MELPILKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 82 - protein, 574 aa, respiratory syncytial virus
MELPILKTNAITTILAAITLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 83 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 84 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 85 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNFCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 86 - protein, 574 aa, respiratory syncytial virus
MELPILKTNSITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 87 - protein, 574 aa, respiratory syncytial virus
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 88 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 89 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 90 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLGKDQLSGINNIAFNN

SEQ ID NO: 91 - protein, 574 aa, respiratory syncytial virus
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSAPVTLSKDQLSGINNIAFSN

SEQ ID NO: 92 - protein, 574 aa, respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKARSTPVTLSKDQLSGINNIAFSN

SEQ ID NO: 93 - protein, 574 aa, respiratory syncytial virus
MELPILKINAITTILAAITLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 94 - protein, 573 aa, respiratory syncytial virus
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFS

SEQ ID NO: 95 - protein, 573 aa, respiratory syncytial virus
MELPILKTNAITTILAAAILCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCRARSTPVTLSKDQLSGINNIAFS

SEQ ID NO: 96 - protein, 574 aa, respiratory syncytial virus
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSFIDGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 97 - protein, 574 aa, respiratory syncytial virus
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 98 - protein, 574 aa, respiratory syncytial virus
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 99 - protein, 574 aa, respiratory syncytial virus
MELPILKTNAITAILAAVTLCFASSQNITEEFYQTTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 100 - protein, 574 aa, respiratory syncytial virus
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 101 - protein, 574 aa, respiratory syncytial virus
MELPILKANAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 102 - protein, 574 aa, respiratory syncytial virus
MELPILKANAITTILAAVILCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 103 - protein, 574 aa, respiratory syncytial virus
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSS

SEQ ID NO: 104 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 105 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVDKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 106 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYGCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 107 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 108 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCRIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 109 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFEASISQVNEKINQSLAFIRKSDELLHHVNAGKSTTNIMITTIIIVIIVILLSLIAVGLLLYCKARSTPVTLSKDQLSGINNIAFSN

SEQ ID NO: 110 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGLLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 111 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGAGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 112 - protein, 574 aa, respiratory syncytial virus
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 113 - protein, 574 aa, respiratory syncytial virus
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 114 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 115 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKNLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 116 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKMLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 117 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKTLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 118 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKQLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 119 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 120 - protein, 574 aa, respiratory syncytial virus
MELPILKANAITTILAAVTFCFASSQNITEEFYQSTCSAVSKGYLSALRTGWYTSVITIELSNIKENKCNGTDAKVKLINQELDKYKNAVTELQLLMQSTTAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 121 - protein, 574 aa, respiratory syncytial virus
MELPILKANAITTILAAVTFCFASSQNITEEFYQSTCSAVSKGYLSALRTGWYTSVITIELSNIKKNKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSRVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAEKCKVQSNRVFCDTMYSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 122 - protein, 574 aa, respiratory syncytial virus
  misc_feature (428)..(435): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSAPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKXXXXXXXXSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 123 - protein, 574 aa, respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTVIDDYLSGINNISFIY

SEQ ID NO: 124 - protein, 574 aa, respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 125 - protein, 574 aa, respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 126 - protein, 574 aa, respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 127 - protein, 574 aa, respiratory syncytial virus
MELLILKANAITTILTAVTFCFASGQNITEEFYQSTCSAVSKGYLSALRTGWYTSVITIELSNIKKNKCNGTDAKIKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 128 - protein, 574 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 129 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 130 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 131 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 132 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGVAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 133 - protein, 574 aa, respiratory syncytial virus
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 134 - protein, 574 aa, respiratory syncytial virus
  misc_feature (275)..(275): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMXSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVRGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 135 - protein, 574 aa, respiratory syncytial virus
  misc_feature (272)..(272): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKXLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 136 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMLSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 137 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTHMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 138 - protein, 573 aa, respiratory syncytial virus
MELLIHRSSAIFLTLAINALYLTSSQNITEEFYQSTCSVVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 139 - protein, 573 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 140 - protein, 573 aa, respiratory syncytial virus
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 141 - protein, 573 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPHYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 142 - protein, 564 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQL

SEQ ID NO: 143 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 144 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 145 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 146 - protein, 574 aa, respiratory syncytial virus
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDSSISQVNEKINQSLAFIRRSDELLHNVNTGKSTTNIMITAIIIVIIVVLLSLIAIGLLLYCKAKNTPVTLSKDQLSGINNIAFSK

SEQ ID NO: 147 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFGVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 148 - protein, 573 aa, respiratory syncytial virus
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 149 - protein, 573 aa, respiratory syncytial virus
MELVIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 150 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 151 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPTANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 152 - protein, 574 aa, respiratory syncytial virus
MELLIHRSSAIFLTLAINAFYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 153 - protein, 573 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 154 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 155 - protein, 574 aa, respiratory syncytial virus
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 156 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAKNTPVTLSKDQLSGINNIAFSK

SEQ ID NO: 157 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 158 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKIQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 159 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 160 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNARVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 161 - protein, 574 aa, respiratory syncytial virus
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 162 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 163 - protein, 574 aa, respiratory syncytial virus
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 164 - protein, 574 aa, respiratory syncytial virus
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQICRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 165 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTRNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 166 - protein, 574 aa, respiratory syncytial virus
MELLIYRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 167 - protein, 574 aa, respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 168 - protein, 573 aa, respiratory syncytial virus
MELLIHRSSAIFLTLSINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTQCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 169 - protein, 574 aa, respiratory syncytial virus
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 170 - protein, 574 aa, respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIGTVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 171 - protein, 574 aa, respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 172 - protein, 574 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 173 - protein, 574 aa, respiratory syncytial virus
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAVNNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKELMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 174 - protein, 564 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITRGFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLCYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 175 - protein, 564 aa, respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISTIETVIEFQQKNSRLLEINREFSVNAGVTTPLSTYMLTNSELLSLINDMPITNDQKKLMSSNVQIVRQQSYSIMSIIKEEVLAYVVRLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 176 - protein, 573 aa, respiratory syncytial virus
MELLIHRSSAVFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCRAKNTPVTLSKDQLSGINNIAFR

SEQ ID NO: 177 - protein, 574 aa, respiratory syncytial virus
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNGELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKEQLSGINNIAFSK

SEQ ID NO: 178 - protein, 574 aa, respiratory syncytial virus
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 179 - protein, 574 aa, respiratory syncytial virus
MATTAMTMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRSIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 180 - protein, 574 aa, respiratory syncytial virus
MATTAMRMIISIIFISTYVTHITLCQNITEEFYQSTCSAVSRGYLSALRTGWYTSVVTIELSKIQKNVCNSTDSKVKLIKQELERYNNAVVELQSLMQNEPASFSRAKRGIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISKIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 181 - protein, 574 aa, respiratory syncytial virus
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRGIPELIHYTRNSTKKFYGLMGKKRKRRFLGFLLGIGSAVASGVAVSKVLHLEGEVNKIKNALLSTNKAVVSLSNGVSVLTSKVLDLKNYIDKELLPQVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 182 - protein, 574 aa, respiratory syncytial virus
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPGSFSRAKRGIPELIHYTRNSTKKFYGHMGKKRKRRFLGFLLGIGSAIASGVAVSKVLHLEGEVNKIKNALLSTNKAVVSLSNGVSVLTSKVLDLKNYIDKELLPKVNNHDCRISNIETVIDFQQKNNRLLEIAREFSVNAGITTPLSTYMLTNSELLSLINDMPITNDQKKLMSSNVQIVRQQSYSIMSVVKEEVMAYVVQLPIYGVIDTPCWKLHTSPLCTTDNKEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 183 - protein, 574 aa, respiratory syncytial virus
MGTTAMRMVISIIFISTYVTHITLCQNITEEFYQSTCSAVSRGYLSALRTGWYTSVVTIELSKIQKNVCKSTDSKVKLIKQELERYNNAVIELQSLMQNEPASFSRAKRGIPELIHYPRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIGTVIEFQQKNNRLLEIAREFSVNAGITTPLSTYMLTNSELLSLINDMPITNDQKKLMSSNVQIVRQQSYSIMSVVKEEVIAYEVQLPIYGVIDTPCWKIHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFPIGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 184 - protein, 569 aa, respiratory syncytial virus
MRMIISIILISTYVPHITLCQNITEEFYQSTCSAVSRGYLSALRTGWYTSVVTIELSKIQKNVCNGTDSKVKLIKQELERYNNAVVELQSLMQNEPTSSSRAKRGIPESIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSIINDMPITNDQKKLMSSNVQIVRQQSYSIMSVVKEEVIAYVVQLPLYGVIDTPCWKLHTSPLCTTDNEEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYNPLVFPSDEFDASIAQVNAKINQSLAFIRRSDELLHSVDVGKSTTNVVITTIIIVIVVVILMLITVGLLFYCKTRSTPIMLGKDQLSSINNLSFSK

SEQ ID NO: 185 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 186 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGLVPRGSHHHHHHSAWSHPQFEK

SEQ ID NO: 187 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVACSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 188 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSCVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 189 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASCVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSCMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 190 - protein, 568 aa, Artificial sequence
  modified RSV protein
MELLILKANAITTILTAVTFCFASGQNITEEFYQSTCSAVSKGYLSALRTGWYTSVITICLSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLCLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 191 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 192 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQEWDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSWINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 193 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPILNKQSCSISNIETLIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 194 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYFNALTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 195 - protein, 568 aa, Artificial sequence
  modified RSV protein
MELLILKANAITTILTAVTFCFASGQNITEEFYQSTCSAVSKGYLSALRTGWYTSVIWIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 196 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEFLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 197 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVWVSKVLHLEGEVNKIKSALLSTNKAVVSLSNGVSVLTSKVLDLKNYIDKQLLPIVNKQSCSISNIETLIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 198 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFNRTSDELLSAIGGYIPEAPRDGQAYVRKDGEWVLLSTFLGGLVPRGSHHHHHHSAWSHPQFEK

SEQ ID NO: 199 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKSVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 200 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKANVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 201 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKCDVSSSVITSLGAIVSCYGKTKCTASNKNRGIIKTFSNGCDYVSNKGVDTVSVGNTLYYVNKQEGKSLYVKGEPIINFYDPLVFPSDEFCASISQVNEKINQSLAFIRKSDELLSAIGGYIPEAPRDGQAYVRKDGEWVLLSTFLGGLVPRGSHHHHHHSAWSHPQFEK

SEQ ID NO: 202 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGCGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSCITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 203 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNTQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 204 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFTDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 205 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVCVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNCQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 206 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVCVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNCQEGKSLYVKGEPIINFYDPLVFPSDEFDASISQVNEKINQSLAFIRKSDELLGGLVPRGSHHHHHHSAWSHPQFEK

SEQ ID NO: 207 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAICSGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 208 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAICSGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLGGLVPRGSHHHHHHSAWSHPQFEK

SEQ ID NO: 209 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLCVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSCSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 210 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLCVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSCSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGLVPRGSHHHHHHSAWSHPQFEK

SEQ ID NO: 211 - protein, 568 aa, Artificial sequence
  modified RSV protein
MELLILKANAITTILTAVTFCFASGQNITEEFCQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYCKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 212 - protein, 568 aa, Artificial sequence
  modified RSV protein
MELLILKANAITTILTAVTFCFASGQNITEEFYQSTCSAVSKGYLSALRTGWYCSVITIELSNIKENKCNGTDAKVKLIKQELDKYKNAVTELQLLMQSTPATNNRARRELPRFMNYTLNNAKKTNVTLSKKRKRRFLGFLLGVGSAIASGVACSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 213 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRCLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRCDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 214 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGNSTLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 215 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHNESEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 216 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSNASIRKSDELLSAIGGYIPEAPRDGQAYVRKDGEWVLLSTFLGGLVPRGSHHHHHHSAWSHPQFEK

SEQ ID NO: 217 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKNLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 218 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHKEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 219 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAKVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 220 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGESVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 221 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKSLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 222 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFIRKSDELLSAIGGYIPEAPRDGQAYVRKDGEWVLLSTFLGGLVPRGSHHHHHHSAWSHPQFEK

SEQ ID NO: 223 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKSDELLSAIGGYIPEAPRDGQAYVRKDGEWVLLSTFLGGLVPRGSHHHHHHSAWSHPQFEK

SEQ ID NO: 224 - protein, 568 aa, Artificial sequence
  modified RSV protein
MELLILKANAITTILTAVTFCFASGQNITEEFYQSTCSAVSKGYLSALRTGWYTSVITIELSNSKENKCNGTDAKVKLIKQELDKYKNAVTELQLLMQSTPATNNRARRELPRFMNYTLNNAKKTNVTLSKKRKRRFLGFLLGVGSAIASGVAVAKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPSYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 225 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSVLFVASISQVNEKINQSLAFIRKSDELLSAIGGYIPEAPRDGQAYVRKDGEWVLLSTFLGGLVPRGSHHHHHHSAWSHPQFEK

SEQ ID NO: 226 - protein, 568 aa, Artificial sequence
  modified RSV protein
MELLILKANAITTILTAVTFCFASGQNITEEFYQSTCSAVSKGYLSALRTGWYTSVITIELSNSKENKCNGTDAKVKLIKQELDKYKNAVTELQLLMQSTPATNNRARRELPRFMNYTLNNAKKTNVTLSKKRKRRFLGFLLGVGSAIASGVAVAKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPSYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSVLFVASISQVNEKINQSLAFIRKSDELLSAIGGYIPEAPRDGQAYVRKDGEWVLLSTFLGGLVPRGSHHHHHHSAWSHPQFEK

SEQ ID NO: 227 - protein, 568 aa, Artificial sequence
  modified RSV protein
MELLILKANAITTILTAVTFCFASGQNITEEFYQSTCSAVSKGYLSALRTGWYTSVITIELSNLKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 228 - protein, 568 aa, Artificial sequence
  modified RSV protein
MELLILKANAITTILTAVTFCFASGQNITEEFYQSTCSAVSKGYLSALRTGWYTSVITIELSNLKENKCNGTDAKVKLLKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFFDKQFLPIVNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 229 - protein, 568 aa, Artificial sequence
  modified RSV protein
MELLILKANAITTILTAVTFCFASGQNITEEFYQSTCSAVSKGYLSALRTGWYTSVITIELSNWKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 230 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLVKQELDKFKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 231 - protein, 568 aa, Artificial sequence
  modified RSV protein
MELLILKANAITTILTAVTFCFASGQNITEEFYQSTCSAVSKGYLSALRTGWYTSVITIELSNVKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFYDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 232 - protein, 568 aa, Artificial sequence
  modified RSV protein
MELLILKANAITTILTAVTFCFASGQNITEEFYQSTCSAVSKGYLSALRTGWYTSVITIELSNFKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 233 - protein, 568 aa, Artificial sequence
  modified RSV protein
MELLILKANAITTILTAVTFCFASGQNITEEFYQSTCSAVSKGYLSALRTGWYTSVITIELSNLKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVVDFKNYFDKQFLPILNKQSCSLSNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 234 - protein, 568 aa, Artificial sequence
  modified RSV protein
MELLILKANAITTILTAVTFCFASGQNITEEFYQSTCSAVSKGYLSALRTGWYTSIIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEINKIKSAILSTNKAVLSFSNGVSILTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSVIKEEILIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 235 - protein, 568 aa, Artificial sequence
  modified RSV protein
MELLILKANAITTILTAVTFCFASGQNITEEFYQSTCSAVSKGYLSALRTGWYTSIIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEINKIKSALLSTNKAVLSLSNGVSVLFSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSVIKEEILIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 236 - protein, 568 aa, Artificial sequence
  modified RSV protein
MELLILKANAITTILTAVTFCFASGQNITEEFYQSTCSAVSKGYLSALRTGWYTSLIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVWHLEGELNKVKSAILSTNKAVLSFSNGVSILTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSVIKEELLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 237 - protein, 568 aa, Artificial sequence
  modified RSV protein
MELLILKANAITTILTAVTFCFASGQNITEEFYQSTCSAVSKGYLSALRTGWYTSLIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVYHLEGELNKVKSALLSTNKAVVSLSNGVSILFSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSVIKEELLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 238 - protein, 568 aa, Artificial sequence
  modified RSV protein
MELLILKANAITTILTAVTFCFASGQNITEEFYQSTCSAVSKGYLSALRTGWYTSIIWIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEINKFKSAILSTNKAVLSVSNGVSILTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSVIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 239 - protein, 568 aa, Artificial sequence
  modified RSV protein
MELLILKANAITTILTAVTFCFASGQNITEEFYQSTCSAVSKGYLSALRTGWYTSIIIIELSNLKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEINKIKSALLSTNKAVLSLSNGVSVLFSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSVIKEEILIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 240 - protein, 568 aa, Artificial sequence
  modified RSV protein
MELLILKANAITTILTAVTFCFASGQNITEEFYQSTCSAVSKGYLSALRTGWYTSIIIIELSNIKENKCNGTDAKVKLVKQELDKFKNAVTELQLLMQSTPATNNRARRELPRFMNYTLNNAKKTNVTLSKKRKRRFLGFLLGVGSAIASGVAVSKVLHLEGEINKIKSALLSTNKAVLSLSNGVSVLFSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSVIKEEILIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 241 - protein, 568 aa, Artificial sequence
  modified RSV protein
MELLILKANAITTILTAVTFCFASGQNITEEFYQSTCSAVSKGYLSALRTGWYTSIIWIELSNLKENKCNGTDAKVKLVKQELDKWKNAVTELQLLMQSTPATNNRARRELPRFMNYTLNNAKKTNVTLSKKRKRRFLGFLLGVGSAIASGVAVSKVLHLEGEINKFKSAILSTNKAVLSVSNGVSILTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSVIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 242 - protein, 568 aa, Artificial sequence
  modified RSV protein
MELLILKANAITTILTAVTFCFASGQNITEEFYQSTCSAVSKGYLSALRTGWYTSIIWIELSNIKENKCNGTDAKVKLVKQELDKFKNAVTELQLLMQSTPATNNRARRELPRFMNYTLNNAKKTNVTLSKKRKRRFLGFLLGVGSAIASGVAVSKVLHLEGEINKFKSAILSTNKAVLSVSNGVSILTSKVVDFKNFFDKQFLPILNKQSCSLSNIETVIEFQQKNNRLLEITREFSVNAGVTTPVSTYMLTNSELLSLINDMPITNDQKKLMSNNVQIVRQQSYSIMSVIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 243 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDCKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNICTVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 244 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNCGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGCTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 245 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSCTDVSSSVITSLGAIVSCYGKTKCTASNKNRGIIKTFSNGCDYVSNKGVDTVSVGNTLYYVNKQEGKSLYVKGEPIINFYDPLVFPSDEFDASISCVNEKINQSLAFIRKSDELLSAIGGYIPEAPRDGQAYVRKDGEWVLLSTFLGGLVPRGSHHHHHHSAWSHPQFEK

SEQ ID NO: 246 - protein, 568 aa, Artificial sequence
  modified RSV protein
MELLILKANAITTILTAVTFCFASGQNITEEFYQSTCSAVSKGYLSALRTGWYTSVITCELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKCLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 247 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMCSKTDVSSSVITSLGAIVSCYGKTKCTASNKNRGIIKTFSNGCDYVSNKGVDTVSVGNTLYYVNKQEGKSLYVKGEPIINFYDPLVFPSDCFDASISQVNEKINQSLAFIRKSDELLSAIGGYIPEAPRDGQAYVRKDGEWVLLSTFLGGLVPRGSHHHHHHSAWSHPQFEK

SEQ ID NO: 248 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQWLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 249 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNQFNAAISQVNEKINQSLAFIRKSDELLSAIGGYIPEAPRDGQAYVRKDGEWVLLSTFLGGLVPRGSHHHHHHSAWSHPQFEK

SEQ ID NO: 250 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSHQFHASISQVNEKINQSLAFIRKSDELLSAIGGYIPEAPRDGQAYVRKDGEWVLLSTFLGGLVPRGSHHHHHHSAWSHPQFEK

SEQ ID NO: 251 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPSLLFLASISQVNEKINQSLAFIRKSDELLSAIGGYIPEAPRDGQAYVRKDGEWVLLSTFLGGLVPRGSHHHHHHSAWSHPQFEK

SEQ ID NO: 252 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPSILFIASISQVNEKINQSLAFIRKSDELLSAIGGYIPEAPRDGQAYVRKDGEWVLLSTFLGGLVPRGSHHHHHHSAWSHPQFEK

SEQ ID NO: 253 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPILLFLASISLVNELINQSLAFIRKSDELLSAIGGYIPEAPRDGQAYVRKDGEWVLLSTFLGGLVPRGSHHHHHHSAWSHPQFEK

SEQ ID NO: 254 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPIILFIASISLVNELINQSLAFIRKSDELLSAIGGYIPEAPRDGQAYVRKDGEWVLLSTFLGGLVPRGSHHHHHHSAWSHPQFEK

SEQ ID NO: 255 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSIVDVSSSVITSLGAIVSCYGKTKCTASNKNRGIIKTFSNGCDYVSNKGVDTVSVGNTLYYVNKQEGKSLYVKGEPIINFYDPLVFPILLFLASISLVNLLINQSLAFIRKSDELLSAIGGYIPEAPRDGQAYVRKDGEWVLLSTFLGGLVPRGSHHHHHHSAWSHPQFEK

SEQ ID NO: 256 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSIVDVSSSVITSLGAIVSCYGKTKCTASNKNRGIIKTFSNGCDYVSNKGVDTVSVGNTLYYVNKQEGKSLYVKGEPIINFYDPLVFPIILFIASISLVNLLINQSLAFIRKSDELLSAIGGYIPEAPRDGQAYVRKDGEWVLLSTFLGGLVPRGSHHHHHHSAWSHPQFEK

SEQ ID NO: 257 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFCGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFCQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 258 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGCAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVCGKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 259 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDCAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGCGTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 260 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLCLPSEVNLCNVDIFNPKYDCKIMTSKTDVSSSVITSLGAIVSCYGKTKCTASNKNRGIIKTFSNGCDYVSNKGVDTVSVGCGTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 261 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFGCVNAGVTTPVSTYMLTNSELLSLINDMPITNDQKKLMSNNVCIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 262 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGCSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASICQVNEKINQSLAFIRKSDELLSAIGGYIPEAPRDGQAYVRKDGEWVLLSTFLGGLVPRGSHHHHHHSAWSHPQFEK

SEQ ID NO: 263 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDCKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 264 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGCAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVCTSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 265 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLCLPSEVNLCNVDIFNPKYDCKIMTSKTDVSSSVITSLGAIVSCYGKTKCTASNKNRGIIKTFSNGCDYVSNKGVDTVSVGCTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 266 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDCMNSLTLPSEVNLCNVDIFNPKYDCKIMTSKTDVSSSVITSLGAIVSCYGKTKCTASNKNRGIIKTFSNGCDYVSNKGVDTVSVGNCLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 267 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGCYCDNAGSVSFCPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 268 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVCSSVITSLGAIVSCYGKCKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 269 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTCPLCTTNTKEGSNICLTRTDRGWYCDNAGSVSFFPQAETCKVQSNRVFCDTMNSLTLPSEVNLCNVDIFNPKYDCKIMTSKTDVSSSVITSLGACVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 270 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTCVSSSVITSLGAIVSCCGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 271 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNCCNVDIFCPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 272 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSCLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVCCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 273 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTCPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVCCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 274 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSCICLTRTDRGWYCDNAGSVSFFPQAETCKVQSNRVFCDTMNSLTLPSEVNLCNVDIFNPKYDCKIMTSKTCVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 275 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSCLCTTNTKEGSNICLCRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 276 - protein, 568 aa, Artificial sequence
  modified RSV protein
MELLILKANAITTILTAVTFCFASGQNITEEFYQSTCSAVSKGYLCALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDCPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 277 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSCITSLGACVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 278 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNCCNVDIFNPKCDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 279 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAECCKVQSNRVFCDTMCSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 280 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVCSSVITSLGAIVSCCGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 281 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPCCTTNTKEGSNICCTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 282 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTCRGWYCDNAGSVSFFPQAETCKVQSNRVFCDTMNSLTLPSEVNLCNVDIFNPKYDCCIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 283 - protein, 568 aa, Artificial sequence
  modified RSV protein
MELLILKANAITTILTAVTFCFASGQNITEEFYQSTCSAVSKGYLSACRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGCIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 284 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSCMSIIKEEVLAYCVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 285 - protein, 568 aa, Artificial sequence
  modified RSV protein
MELLILKANAITTILTAVTFCFASGQNITCEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSCGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 286 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 287 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCWIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 288 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKTDVSSSVITSLGAIVSCYGKTKCTASNKNRGIIKTFSNGCDYVSNKGVDTVSVGNTLYYVNKQEGKSLYVKGEPIINFYDPLVFPSNQFNAAISQVNEKINQSLAFIRKSDELLSAIGGYIPEAPRDGQAYVRKDGEWVLLSTFLGGLVPRGSHHHHHHSAWSHPQFEK

SEQ ID NO: 289 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKTDVSSSVITSLGAIVSCYGKTKCTASNKNRGIIKTFSNGCDYVSNKGVDTVSVGNTLYYVNKQEGKSLYVKGEPIINFYDPLVFPSHQFHASISQVNEKINQSLAFIRKSDELLSAIGGYIPEAPRDGQAYVRKDGEWVLLSTFLGGLVPRGSHHHHHHSAWSHPQFEK

SEQ ID NO: 290 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCWIMTSKTDVSSSVITSLGAIVSCYGKTKCTASNKNRGIIKTFSNGCDYVSNKGVDTVSVGNTLYYVNKQEGKSLYVKGEPIINFYDPLVFPSNQFNAAISQVNEKINQSLAFIRKSDELLSAIGGYIPEAPRDGQAYVRKDGEWVLLSTFLGGLVPRGSHHHHHHSAWSHPQFEK

SEQ ID NO: 291 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCWIMTSKTDVSSSVITSLGAIVSCYGKTKCTASNKNRGIIKTFSNGCDYVSNKGVDTVSVGNTLYYVNKQEGKSLYVKGEPIINFYDPLVFPSHQFHASISQVNEKINQSLAFIRKSDELLSAIGGYIPEAPRDGQAYVRKDGEWVLLSTFLGGLVPRGSHHHHHHSAWSHPQFEK

SEQ ID NO: 292 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKVDVSSSVITSLGAIVSCYGKTKCTASNKNRGIIKTFSNGCDYVSNKGVDTVSVGNTLYYVNKQEGKSLYVKGEPIINFYDPLVFPSLLFLASISLVNEMINQSLAFIRKSDELLSAIGGYIPEAPRDGQAYVRKDGEWVLLSTFLGGLVPRGSHHHHHHSAWSHPQFEK

SEQ ID NO: 293 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKVDVSSSVITSLGAIVSCYGKTKCTASNKNRGIIKTFSNGCDYVSNKGVDTVSVGNTLYYVNKQEGKSLYVKGEPIINFYDPLVFPSILFIASISLVNEMINQSLAFIRKSDELLSAIGGYIPEAPRDGQAYVRKDGEWVLLSTFLGGLVPRGSHHHHHHSAWSHPQFEK

SEQ ID NO: 294 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCWIMTSKVDVSSSVITSLGAIVSCYGKTKCTASNKNRGIIKTFSNGCDYVSNKGVDTVSVGNTLYYVNKQEGKSLYVKGEPIINFYDPLVFPSLLFLASISLVNEMINQSLAFIRKSDELLSAIGGYIPEAPRDGQAYVRKDGEWVLLSTFLGGLVPRGSHHHHHHSAWSHPQFEK

SEQ ID NO: 295 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCWIMTSKVDVSSSVITSLGAIVSCYGKTKCTASNKNRGIIKTFSNGCDYVSNKGVDTVSVGNTLYYVNKQEGKSLYVKGEPIINFYDPLVFPSILFIASISLVNEMINQSLAFIRKSDELLSAIGGYIPEAPRDGQAYVRKDGEWVLLSTFLGGLVPRGSHHHHHHSAWSHPQFEK

SEQ ID NO: 296 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSGCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 297 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNGCNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 298 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSGCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 299 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNGCNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 300 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRARRFLGFLLGVGSAIASGVAVCKVLHLEGEVNKIKSALLSTNKAVVSLSGCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 301 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRARRFLGFLLGVGSAIASGVAVCKVLHLEGEVNKIKSALLSTNKAVVSLSCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNGCNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 302 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFCLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDCSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 303 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFCLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDCSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 304 - protein, 515 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCCFDASGGLVPRGSHHHHHHSAWSHPQFEK

SEQ ID NO: 305 - protein, 518 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASFLGGLVPRGSHHHHHHSAWSHPQFEK

SEQ ID NO: 306 - protein, 516 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSGCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSCCFDASGGLVPRGSHHHHHHSAWSHPQFEK

SEQ ID NO: 307 - protein, 517 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSCGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNGCNRGIIKTFSNGCDYVSNKGVDTVSVGNTLYYVNKQEGKSLYVKGEPIINFYDPLVFPSCPCFDASGGLVPRGSHHHHHHSAWSHPQFEK

SEQ ID NO: 308 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFCLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDCSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 309 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFCLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDCSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 310 - protein, 518 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGCSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASICGGLVPRGSHHHHHHSAWSHPQFEK

SEQ ID NO: 311 - protein, 519 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSCNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASIGCGGLVPRGSHHHHHHSAWSHPQFEK

SEQ ID NO: 312 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKNRARRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 313 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 314 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNWGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 315 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNIGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 316 - protein, 527 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGGNGIGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 317 - protein, 526 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGGSGGSGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 318 - protein, 524 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 319 - protein, 473 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGLVPRGSHHHHHHSAWSHPQFEK

SEQ ID NO: 320 - protein, 494 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 321 - protein, 548 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNGGLVPRGSHHHHHHSAWSHPQFEK

SEQ ID NO: 322 - protein, 506 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNIGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLY

SEQ ID NO: 323 - protein, 549 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRARRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLY

SEQ ID NO: 324 - protein, 574 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 325 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNIGLGGSGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 326 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDMGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 327 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 328 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSHHHHHHSAWSHPQFEK

SEQ ID NO: 329 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNQWNAAISQVNEKINQSLAFIRKSDELLSAIGGYIPEAPRDGQAYVRKDGEWVLLSTFLGGLVPRGSHHHHHHSAWSHPQFEK

SEQ ID NO: 330 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSHQWHASISQVNEKINQSLAFIRKSDELLSAIGGYIPEAPRDGQAYVRKDGEWVLLSTFLGGLVPRGSHHHHHHSAWSHPQFEK

SEQ ID NO: 331 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPSLLWLASISQVNEKINQSLAFIRKSDELLSAIGGYIPEAPRDGQAYVRKDGEWVLLSTFLGGLVPRGSHHHHHHSAWSHPQFEK

SEQ ID NO: 332 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPSILWIASISQVNEKINQSLAFIRKSDELLSAIGGYIPEAPRDGQAYVRKDGEWVLLSTFLGGLVPRGSHHHHHHSAWSHPQFEK

SEQ ID NO: 333 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNQFNAAISQVNEKINQSLAFIRKSDELLSAIGGYIPEAPRDGQAYVRKDGEWVLLSTFLGGLVPRGSHHHHHHSAWSHPQFEK

SEQ ID NO: 334 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSHQFHASISQVNEKINQSLAFIRKSDELLSAIGGYIPEAPRDGQAYVRKDGEWVLLSTFLGGLVPRGSHHHHHHSAWSHPQFEK

SEQ ID NO: 335 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKVDVSSSVITSLGAIVSCYGKTKCTASNKNRGIIKTFSNGCDYVSNKGVDTVSVGNTLYYVNKQEGKSLYVKGEPIINFYDPLVFPSLLFLASISQVNEKINQSLAFIRKSDELLSAIGGYIPEAPRDGQAYVRKDGEWVLLSTFLGGLVPRGSHHHHHHSAWSHPQFEK

SEQ ID NO: 336 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTWPSEVNLCNVDIFNPKFDCMIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 337 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDMGWYCDNAGSVSFFPQAETCKVQSNRVFCDTMNSLTWPSEVNLCNVDIFNPKFDCMIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 338 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGCAAAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 339 - protein, 571 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSAAACGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNCNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 340 - protein, 571 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGCAASNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASICQVNEKINQSLAFIRKSDELLSAIGGYIPEAPRDGQAYVRKDGEWVLLSTFLGGLVPRGSHHHHHHSAWSHPQFEK

SEQ ID NO: 341 - protein, 252 aa, Artificial sequence
  modified RSV protein
MDSKGSSQKGSRLLLLLVVSNLLLPQGVLATGWYTSVITIELSNIKENKCNGTDAKVKLIKQELDKYKNAVTELQLLMGGSGGSGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGLVPRGSHHHHHHSAWSHPQFEK

SEQ ID NO: 342 - protein, 271 aa, Artificial sequence
  modified RSV protein
MDSKGSSQKGSRLLLLLVVSNLLLPQGVLATGWYTSVITIELSNIKENKCNGTDAKVKLIKQELDKYKNAVTELQLLGGGSGGGSGGGSIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGLVPRGSHHHHHHSAWSHPQFEK

SEQ ID NO: 343 - protein, 271 aa, Artificial sequence
  modified RSV protein
MDSKGSSQKGSRLLLLLVVSNLLLPQGVLATGWYTSVITIELSNIKENKCNGTDAKVKLIKQELDKYKNAVTELQLLGGGSGGGSGGGSIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGLVPRGSHHHHHHSAWSHPQFEK

SEQ ID NO: 344 - protein, 825 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGSGSYLFRLCYSCASQMIWGPWEPIYEIIYANMPINTEMTDFTAVVGKKFAEGKPLDIPVISQPYGKRVVAFAEHSVIPGKEKQFEDAIVRTLEMLKKAPGFLGAMVLKEIGVSGIGSMQFGAKGFHQVLENPGSLEPDPNNVMYSVPEAKNTPQQYIVHVEWANTDALMFGMGRVLLYPELRQVHDEVLDTLVYGPYIRILNPMMEGTFWREYLNEGSGPKPYVAINMAELKNEPKTFEMFASVGPKVCMVTARHPGFVGFQNHIQIGILPFGNRYGGAKMDMTKESSTVRVLQYTFWKDWKDHEEMHRQNW

SEQ ID NO: 345 - protein, 825 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGSGSYLFRLCYSCASQMVWGPWEPIYEIKYADMPINTEMTDFTAVVGKKFAEGKPLEIPVISQPYGKRVVAFGEHTVIPGKEEQFEDAIIKTLEMFKRAPGFLGAMLLKEIGVSGIGSFQFGSKGFHQLLESPGSLEPDPNNVMYQAPEAKPTPPQYIVHVEWANLDALQFGMGRVLLSPEYREVHDEALDTLIYGPYIRIINPVMEGTFWREYLNEGSGPKPYIAINMADLKNEPKTFEMFSAVGPKVCMVTARHPGFVGFQNHVQIGVLPFGERFGGAKMDMTKESSTVRVLQYTMWKDWKDHEEMHRQNW

SEQ ID NO: 346 - protein, 670 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLAQLSLELRKPITFGVITADTLEQAIERAGTKHGNKGWEAALSAIEMANLFKSLR

SEQ ID NO: 347 - protein, 669 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGMVFEGHLVGTGLKVGVVVGRFNEFITSKLLGGALDGLKRHGVEENDIDVAWVPGAFEIPLIAKKMANSGKYDAVITLGTVIRGATTHYDYVCNEVAKGVASLSLQTDIPVIFGVLTTETIEQAIERAGTKAGNKGYESAVAAIEMAHLSKHWA

SEQ ID NO: 348 - protein, 670 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGMNIIKANVAAPDARVAITIARFNQFIQDSLLDGAVDALTRIGQVKDDQITVVWVPGAYELPLATEALAKSGKYDAVVALGTVIRGGTAHFEYVAGGASNGLASVAQDSGVPVAFGVLTTESIEQAIERAGTKAGNKGAEAALTALEMINVLKAI

SEQ ID NO: 349 - protein, 757 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELGSGAAAKPATTEGEFPETREKMSGIRRAIAKAMVHSKHTAPHVTLMDEADVTKLVAHRKKFKAIAAEKGIKLTFLPYVVKALVSALREYPVLQTSIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 350 - protein, 679 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 351 - protein, 26 aa, Artificial sequence
  foldon domain
GYIPEAPRDGQAYVRKDGEWVLLSTF

SEQ ID NO: 352 - protein, 9 aa, Artificial sequence
  linker
GGSGGSGGS

SEQ ID NO: 353 - protein, 167 aa, Artificial sequence
  ferritin polypeptide
MLSKDIIKLLNEQVNKEMNSSNLYMSMSSWCYTHSLDGAGLFLFDHAAEEYEHAKKLIVFLNENNVPVQLTSISAPEHKFEGLTQIFQKAYEHEQHISESINNIVDHAIKGKDHATFNFLQWYVAEQHEEEVLFKDILDKIELIGNENHGLYLADQYVKGIAKSRKS

SEQ ID NO: 354 - protein, 265 aa, Artificial sequence [sequence omitted]

SEQ ID NO: 355 - protein, 9 aa, Artificial sequence
  linker
GLEVLFQGP

SEQ ID NO: 356 - protein, 9 aa, Artificial sequence
  linker
GSGNVGLGG

SEQ ID NO: 357 - protein, 9 aa, Artificial sequence
  linker
GSGNWGLGG

SEQ ID NO: 358 - protein, 9 aa, Artificial sequence
  linker
GSGNIGLGG

SEQ ID NO: 359 - protein, 11 aa, Artificial sequence
  linker
GSGGNGIGLGG

SEQ ID NO: 360 - protein, 10 aa, Artificial sequence
  linker
GSGGSGGSGG

SEQ ID NO: 361 - protein, 8 aa, Artificial sequence
  linker
GSGNVLGG

SEQ ID NO: 362 - protein, 9 aa, Artificial sequence
  linker
GSGNVGLGG

SEQ ID NO: 363 - protein, 9 aa, Artificial sequence
  linker
GSGNVGLGG

SEQ ID NO: 364 - protein, 9 aa, Artificial sequence
  linker
GSGNIGLGG

SEQ ID NO: 365 - protein, 9 aa, Artificial sequence
  linker
GSGNIGLGG

SEQ ID NO: 366 - protein, 124 aa, Homo sapiens
QVQLVQSGAEVKKPGATVKVSCKISGHTLIKLSIHWVRQAPGKGLEWMGGYEGEVDEIFYAQKFQHRLTVIADTATDTVYMELGRLTSDDTAVYFCGTLGVTVTEAGLGIDDYWGQGTLVTVSS

SEQ ID NO: 367 - protein, 109 aa, Homo sapiens
EIVLTQSPGTLSLSPGERATLSCRASQIVSRNHLAWYQQKPGQAPRLLIFGASSRATGIPVRFSGSGSGTDFTLTINGLAPEDFAVYYCLSSDSSIFTFGPGTKVDFKR

SEQ ID NO: 368 - protein, 126 aa, Homo sapiens [sequence omitted]

SEQ ID NO: 369 - protein, 108 aa, Homo sapiens
DIQMTQSPSSLSAAVGDRVTITCQASQDIVNYLNWYQQKPGKAPKLLIYVASNLETGVPSRFSGSGSGTDFSLTISSLQPEDVATYYCQQYDNLPLTFGGGTKVEIKR

SEQ ID NO: 370 - protein, 574 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 371 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 372 - protein, 568 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEINREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 373 - protein, 568 aa, Artificial sequence
  modified RSV protein
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVCKVLHLEGEVNKIKNALLSTNKAVVSLSNGVSVLTFKVLDLKNYIDKELLPKLNNHDCRISNIETVIEFQQKNNRLLEIAREFSVNAGITTPLSTYMLTNSELLSLINDMPITNDQKKLMSSNVQIVRQQSYSIMCVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLSAIGGYIPEAPRDGQAYVRKDGEWVLLSTFLGGLVPRGSHHHHHHSAWSHPQFEK

SEQ ID NO: 374 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 375 - protein, 568 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 376 - protein, 568 aa, Artificial sequence
  modified RSV protein
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVCKVLHLEGEVNKIKNALLSTNKAVVSLSNGVSVLTFKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMCVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLSAIGGYIPEAPRDGQAYVRKDGEWVLLSTFLGGLVPRGSHHHHHHSAWSHPQFEK

SEQ ID NO: 377 - protein, 679 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 378 - protein, 679 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEINREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 379 - protein, 679 aa, Artificial sequence
  modified RSV protein
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVCKVLHLEGEVNKIKNALLSTNKAVVSLSNGVSVLTFKVLDLKNYIDKELLPKLNNHDCRISNIETVIEFQQKNNRLLEIAREFSVNAGITTPLSTYMLTNSELLSLINDMPITNDQKKLMSSNVQIVRQQSYSIMCVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 380 - protein, 679 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 381 - protein, 679 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 382 - protein, 679 aa, Artificial sequence
  modified RSV protein
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVCKVLHLEGEVNKIKNALLSTNKAVVSLSNGVSVLTFKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMCVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 383 - DNA, 1710 bp, Artificial sequence
  DNA encoding modified RSV protein
atggaactgctgatcctgaaggccaacgccatcaccaccatcctgaccgccgtgaccttctgcttcgccagcggccagaacatcaccgaggaattctaccagagcacctgcagcgccgtgagcaagggctacctgagcgccctgcggaccggctggtacaccagcgtgatcaccatcgagctgtccaacatcaaagaaaacaagtgcaacggcaccgacgccaaagtgaagctgatcaagcaggaactggacaagtacaagaacgccgtgaccgagctgcagctgctgatgcagagcacccccgccaccaacaacagagccagaagagagctgccccggttcatgaactacaccctgaacaacgccaagaaaaccaacgtgaccctgagcaagaagagaaagagaagattcctgggcttcctgctgggcgtgggcagcgccattgccagcggcgtggccgtgtgtaaagtgctgcacctggaaggcgaagtgaacaagatcaagtccgccctgctgtccaccaacaaggccgtggtgtccctgagcaacggcgtgagcgtgctgaccttcaaggtgctggatctgaagaactacatcgacaagcagctgctgcccatcctgaacaagcagagctgcagcatcagcaacatcgagacagtgatcgagttccagcagaagaacaaccggctgctggaaatcacccgggagttcagcgtgaacgccggagtgaccacccccgtgtccacctacatgctgaccaacagcgagctgctgtccctgatcaatgacatgcccatcaccaacgaccagaaaaagctgatgagcaacaacgtgcagatcgtgcggcagcagagctactccatcatgtgcatcatcaaagaagaggtgctggcctacgtggtgcagctgcccctgtacggcgtgatcgacaccccctgctggaagctgcacaccagccccctgtgcacaaccaacaccaaagagggcagcaacatctgcctgacccggaccgaccggggctggtactgcgacaacgccggcagcgtgtccttctttccacaggccgagacatgcaaggtgcagagcaaccgggtgttctgcgacaccatgaacagcctgaccctgccctccgaagtgaacctgtgcaacgtggacatcttcaaccccaagtacgactgcaagatcatgacctccaagaccgacgtgtccagctccgtgatcacctccctgggcgccatcgtgtcctgctacggcaagaccaagtgcaccgccagcaacaagaacagaggcatcatcaagaccttcagcaacggctgcgactacgtgtccaataagggcgtggacaccgtgtccgtgggcaacacactgtactacgtgaataagcaggaaggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgaactgctgtccgccatcggcggctacatccccgaggcccccagagatggccaggcctacgtgcggaaggacggcgagtgggtgctgctgtctacatttctgggcggcctggtgcctagaggctctcaccaccaccatcaccacagcgcctggtcccacccccagttcgagaagtgatga

SEQ ID NO: 384 - DNA, 6251 bp, Artificial sequence
  DNA encoding modified RSV protein
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagcgcctctgctaaccatgttcatgccttcttctttttcctacagctcctgggcaacgtgctggttgttgtgctgtctcatcattttggcaaagaattgcggccgtctcaggccgagttcggtaccgccaccatggaactgctgatcctgaaggccaacgccatcaccaccatcctgaccgccgtgaccttctgcttcgccagcggccagaacatcaccgaggaattctaccagagcacctgcagcgccgtgagcaagggctacctgagcgccctgcggaccggctggtacaccagcgtgatcaccatcgagctgtccaacatcaaagaaaacaagtgcaacggcaccgacgccaaagtgaagctgatcaagcaggaactggacaagtacaagaacgccgtgaccgagctgcagctgctgatgcagagcacccccgccaccaacaacagagccagaagagagctgccccggttcatgaactacaccctgaacaacgccaagaaaaccaacgtgaccctgagcaagaagagaaagagaagattcctgggcttcctgctgggcgtgggcagcgccattgccagcggcgtggccgtgtgtaaagtgctgcacctggaaggcgaagtgaacaagatcaagtccgccctgctgtccaccaacaaggccgtggtgtccctgagcaacggcgtgagcgtgctgaccttcaaggtgctggatctgaagaactacatcgacaagcagctgctgcccatcctgaacaagcagagctgcagcatcagcaacatcgagacagtgatcgagttccagcagaagaacaaccggctgctggaaatcacccgggagttcagcgtgaacgccggagtgaccacccccgtgtccacctacatgctgaccaacagcgagctgctgtccctgatcaatgacatgcccatcaccaacgaccagaaaaagctgatgagcaacaacgtgcagatcgtgcggcagcagagctactccatcatgtgcatcatcaaagaagaggtgctggcctacgtggtgcagctgcccctgtacggcgtgatcgacaccccctgctggaagctgcacaccagccccctgtgcacaaccaacaccaaagagggcagcaacatctgcctgacccggaccgaccggggctggtactgcgacaacgccggcagcgtgtccttctttccacaggccgagacatgcaaggtgcagagcaaccgggtgttctgcgacaccatgaacagcctgaccctgccctccgaagtgaacctgtgcaacgtggacatcttcaaccccaagtacgactgcaagatcatgacctccaagaccgacgtgtccagctccgtgatcacctccctgggcgccatcgtgtcctgctacggcaagaccaagtgcaccgccagcaacaagaacagaggcatcatcaagaccttcagcaacggctgcgactacgtgtccaataagggcgtggacaccgtgtccgtgggcaacacactgtactacgtgaataagcaggaaggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgaactgctgtccgccatcggcggctacatccccgaggcccccagagatggccaggcctacgtgcggaaggacggcgagtgggtgctgctgtctacatttctgggcggcctggtgcctagaggctctcaccaccaccatcaccacagcgcctggtcccacccccagttcgagaagtgatgagcggccgccatgaattccatcaccaccatcatcaccatcattgactcgagcgataattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 385 - DNA, 1710 bp, Artificial sequence
  modified RSV sequnce
atggagctgctgattcaccgatcttccgctattttcctgaccctggctgtcaacgccctgtacctgacttcctcacagaacattactgaggaattctaccagagcacatgcagcgccgtgagccgaggatacttttccgcactgagaactggctggtataccagcgtgatcacaattgagctgtccaatatcaaggaaaccaaatgtaacggcaccgacacaaaggtgaaactgatcaagcaggagctggataagtataaaaatgccgtgacagaactgcagctgctgatgcagaacactcctgccgctaacaatcgggctcggagagaggcaccacagtacatgaactataccattaataccacaaagaacctgaatgtgagcatctccaagaaaagaaaaaggcgcttcctgggctttctgctgggagtgggaagcgcaatcgcatccggaattgccgtgtgcaaggtcctgcacctggagggcgaagtgaacaagatcaaaaatgcactgctgagtaccaacaaggccgtggtctctctgagtaacggggtgtctgtcctgacattcaaggtgctggacctgaaaaactacatcaacaatcgactgctgcctattctgaatcagcagtcttgtcgcatcagtaacattgagactgtgattgaattccagcagatgaattcccgcctgctggagatcacccgagaattttctgtgaacgccggcgtcactacccccctgagtacttacatgctgaccaattcagagctgctgagcctgatcaacgacatgcctattaccaatgatcagaagaaactgatgagctccaacgtgcagattgtcaggcagcagtcatatagcatcatgtgcatcattaaggaggaagtgctggcttacgtggtccagctgcctatctatggggtcattgacactccatgctggaagctgcatacctcccccctgtgcacaactaacatcaaagagggatctaatatttgcctgactagaaccgacaggggctggtactgtgataatgccgggtccgtgtctttctttccacaggctgacacatgcaaggtgcagtcaaatagggtcttctgtgatacaatgaacagcctgactctgcccagtgaagtgtcactgtgcaacacagacatcttcaactcaaagtacgattgtaagatcatgacaagcaagactgatatctctagttcagtgattactagtctgggagctatcgtctcatgctacggcaagaccaaatgtacagcatccaacaagaatcgcgggatcatcaagaccttcagcaatggatgtgactatgtgagtaacaagggggtcgataccgtgagcgtcggaaacacactgtactatgtgaataagctggagggcaaaaacctgtacgtcaaaggggaacccatcattaactactatgacccactggtgttcccctccgacgagtttgatgccagtatctcacaggtcaacgaaaagattaatcagagcctggcattcatccgacggtccgatgagctgctgtctgccatcggcgggtacattcccgaagcccctagggacggccaggcttatgtgcgcaaagatggggagtgggtcctgctgagcacctttctgggaggcctggtgcctcggggcagccaccaccaccaccaccacagtgcttggagccacccacagtttgaaaaatgatga

SEQ ID NO: 386 - DNA, 6251 bp, Artificial sequence
  modified RSV sequnce
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagcgcctctgctaaccatgttcatgccttcttctttttcctacagctcctgggcaacgtgctggttgttgtgctgtctcatcattttggcaaagaattgcggccgtctcaggccgagttcggtaccgccaccatggagctgctgattcaccgatcttccgctattttcctgaccctggctgtcaacgccctgtacctgacttcctcacagaacattactgaggaattctaccagagcacatgcagcgccgtgagccgaggatacttttccgcactgagaactggctggtataccagcgtgatcacaattgagctgtccaatatcaaggaaaccaaatgtaacggcaccgacacaaaggtgaaactgatcaagcaggagctggataagtataaaaatgccgtgacagaactgcagctgctgatgcagaacactcctgccgctaacaatcgggctcggagagaggcaccacagtacatgaactataccattaataccacaaagaacctgaatgtgagcatctccaagaaaagaaaaaggcgcttcctgggctttctgctgggagtgggaagcgcaatcgcatccggaattgccgtgtgcaaggtcctgcacctggagggcgaagtgaacaagatcaaaaatgcactgctgagtaccaacaaggccgtggtctctctgagtaacggggtgtctgtcctgacattcaaggtgctggacctgaaaaactacatcaacaatcgactgctgcctattctgaatcagcagtcttgtcgcatcagtaacattgagactgtgattgaattccagcagatgaattcccgcctgctggagatcacccgagaattttctgtgaacgccggcgtcactacccccctgagtacttacatgctgaccaattcagagctgctgagcctgatcaacgacatgcctattaccaatgatcagaagaaactgatgagctccaacgtgcagattgtcaggcagcagtcatatagcatcatgtgcatcattaaggaggaagtgctggcttacgtggtccagctgcctatctatggggtcattgacactccatgctggaagctgcatacctcccccctgtgcacaactaacatcaaagagggatctaatatttgcctgactagaaccgacaggggctggtactgtgataatgccgggtccgtgtctttctttccacaggctgacacatgcaaggtgcagtcaaatagggtcttctgtgatacaatgaacagcctgactctgcccagtgaagtgtcactgtgcaacacagacatcttcaactcaaagtacgattgtaagatcatgacaagcaagactgatatctctagttcagtgattactagtctgggagctatcgtctcatgctacggcaagaccaaatgtacagcatccaacaagaatcgcgggatcatcaagaccttcagcaatggatgtgactatgtgagtaacaagggggtcgataccgtgagcgtcggaaacacactgtactatgtgaataagctggagggcaaaaacctgtacgtcaaaggggaacccatcattaactactatgacccactggtgttcccctccgacgagtttgatgccagtatctcacaggtcaacgaaaagattaatcagagcctggcattcatccgacggtccgatgagctgctgtctgccatcggcgggtacattcccgaagcccctagggacggccaggcttatgtgcgcaaagatggggagtgggtcctgctgagcacctttctgggaggcctggtgcctcggggcagccaccaccaccaccaccacagtgcttggagccacccacagtttgaaaaatgatgagcggccgccatgaattccatcaccaccatcatcaccatcattgactcgagcgataattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgccatatgctggctgccatgaacaaaggtggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 387 - DNA, 1710 bp, Artificial sequence; identical to SEQ ID NO: 385
  modified RSV sequnce

SEQ ID NO: 388 - DNA, 6251 bp, Artificial sequence; identical to SEQ ID NO: 386
  modified RSV sequnce

SEQ ID NO: 389 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSHHHHHHSAWSHPQFEK

SEQ ID NO: 390 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAWKRKFDELLGGLVPRGSHHHHHHSAWSHPQFEK

SEQ ID NO: 391 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRFLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 392 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 393 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQLLPIVNKQSCSISNIETVIEFQQKNNRFLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 394 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQLLPIVNKQSCSISNIETVIEFQQKNNRFLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSHHHHHHSAWSHPQFEK

SEQ ID NO: 395 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 396 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSFLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 397 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 398 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNWIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 399 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLFPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 400 - protein, 568 aa, Artificial sequence
  modified RSV sequnce
MELLILKANAITTILTAVTFCFASGQNITEEFYQSTCSAVSKGYLSALRTGWFTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVFTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 401 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSFLTSKVLDLKNYIDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 402 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 403 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFWLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 404 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLFGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 405 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLWGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 406 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGFGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 407 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGWGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 408 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAFTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 409 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 410 - protein, 568 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGFSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 411 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 412 - protein, 568 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQELDKYKNAFTELQLLMQSTPATNNRARRELPRFMNYTLNNAKKTNVTLSKKRKRRFLGFLLGVGSAIASGVAVSKVLHLEGEVNKIKSALLSTNKAVVSLSNGFSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 413 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 414 - protein, 568 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGFSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 415 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAFTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 416 - protein, 568 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGFSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 417 - protein, 568 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQELDKYKNAFTELQLLMQSTPATNNRARRELPRFMNYTLNNAKKTNVTLSKKRKRRFLGFLLGVGSAIASGVAVSKVFHLEGEVNKIKSALLSTNKAVVSLSNGFSVLTSKVLDLKNYIDKQFLPIVNKQSCSISNIETVIEFQQKNNRFLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELLSAIGGYIPEAPRDGQAYVRKDGEWVLLSTFLGGLVPRGSHHHHHHSAWSHPQFEK

SEQ ID NO: 418 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFCVNAGVTTPVSTYMLTNSELLSLINDMPITNDQKKLMSNNVCIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 419 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVYEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 420 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINFSLAFIRKSDELLSAIGGYIPEAPRDGQAYVRKDGEWVLLSTFLGGLVPRGSHHHHHHSAWSHPQFEK

SEQ ID NO: 421 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTCLQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFCVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 422 - protein, 568 aa, Artificial sequence
  modified RSV sequnce
MELLILKANAITTILTAVTFCFASGQNITEEFYQSTCSAVSKGYLSALRTGWYTSVITCELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVCDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 423 - protein, 568 aa, Artificial sequence
  modified RSV sequnce
MELLILKANAITTILTAVTFCFASGQNITEEFYQSTCSAVSKGYLSALRTGWYTSVITCELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVCAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 424 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSICKEEVCAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 425 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNCAVVSLSNGVSVLTCKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 426 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKCVVSLSNGVSVLCSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 427 - protein, 568 aa, Artificial sequence
  modified RSV sequnce
MELLILKANAITTILTAVTFCFASGQNITEEFYQSTCSAVSKGYLSALRTGWYTSVICIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 428 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 429 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSACLSTNKAVVSLSNGVSVLTSCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 430 - protein, 568 aa, Artificial sequence; identical to SEQ ID NO: 425
  modified RSV sequnce

SEQ ID NO: 431 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 432 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTYKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 433 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTWKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 434 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNCNRGIIKTFSNGCDYVSNKGVCTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 435 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASCVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVCLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 436 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASCVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYCVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 437 - protein, 568 aa, Artificial sequence
  modified RSV sequnce
MELLILKANAITTILTAVTFCFASGQNITEEFYQSTCSAVSKGYLSALRTGWYTSCITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLCSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 438 - protein, 568 aa, Artificial sequence; identical to SEQ ID NO: 429
  modified RSV sequnce

SEQ ID NO: 439 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGWLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 440 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRWLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 441 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTLKLLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 442 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSFLTLKLLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 443 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSLLTLKLLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 444 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGFSLLTLKLLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 445 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVALSKLLHLEGEVNKIKSALLSTNKAVVSLSNGLSLLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 446 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVALSKVLHLEGEVNKIKSALLSTNKAVVSLSNGLSLLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 447 - protein, 568 aa, Artificial sequence; identical to SEQ ID NO: 396
  modified RSV sequnce

SEQ ID NO: 448 - protein, 568 aa, Artificial sequence
  modified RSV sequnce
MELLILKANAITTILTAVTFCFASGQNITEEFYQSTCSAVSKGYLSALRTGWYTSVILIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 449 - protein, 568 aa, Artificial sequence
  modified RSV sequnce
MELLILKANAITTILTAVTFCFASGQNITEEFYQSTCSAVSKGYLSALRTGWYTSVILIELSNIKENKCNGTDAKVKLIKQELDKYKNAVTELQLLMQSTPATNNRARRELPRFMNYTLNNAKKTNVTLSKKRKRRFLGFLLGVGSAIASGVALSKVLHLEGEVNKIKSALLSTNKAVVSLSNGLSLLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 450 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYWVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 451 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKAKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 452 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVWHLEGEVNKAKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 453 - protein, 568 aa, Artificial sequence; identical to SEQ ID NO: 392
  modified RSV sequnce

SEQ ID NO: 454 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVWHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 455 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 456 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 457 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 458 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKFKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 459 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKMKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 460 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAFSKVLHLEGEVNKMKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 461 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAFSKVLHLEGEVNKLKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 462 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 463 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLQTVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 464 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLEKVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 465 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLPIFNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 466 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLQTFNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 467 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLEKFNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 468 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 469 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLQTVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 470 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYLDKQFLEKVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 471 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTLKLLDLKNYLDKQFLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 472 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTLKLLDLKNYLDKQFLQTVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 473 - protein, 568 aa, Artificial sequence
  modified RSV sequnce
MELLILKANAITTILTAVTFCFASGQNITEEFYQSTCSAVSKGYLSALRTGWYTAVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTMKVLDLKNYIDKQFLPIINKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 474 - protein, 568 aa, Artificial sequence
  modified RSV sequnce
MELLILKANAITTILTAVTFCFASGQNITEEFYQSTCSAVSKGYLSALRTGWFTAVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNIAVVSLSNGVSVLTLKVLDLKNYIDKQLLPIINKQSCSISNIETVIEFQQKNNRLLEITREFSVNAGVTTPVSTYMLTNSELLLLINLMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 475 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQLLPIMNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 476 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIMNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 477 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIINKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 478 - protein, 568 aa, Artificial sequence
  modified RSV sequnce
MELLILKANAITTILTAVTFCFASGQNITEEFYQSTCSAVSKGYLSALRTGWYTSIITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIMNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 479 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVALSKVLHLEGEVNKIKSALLSTNKAVVSLSNGVSVLTSKVLDLKNYIDKQLLPIMNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 480 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIINKQSCSISNIEWVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 481 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIINKQSCSISNIEIVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 482 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIEWVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 483 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIEIVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 484 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIELVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 485 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIMNKQSCSISNIETVIEFQQKLNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 486 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIINKQSCSISNIETVIEFQQKLNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 487 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPFMNKQSCSISNIEVVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 488 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIELVIEFQQMNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 489 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIELVIEFQQWNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 490 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNFIDKQLLPIMNKQSCSISNIELVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 491 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNFIDKQLLPIMNKQSCSIGPIELVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 492 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNFIDKQLLPIMNKQSCGIGNIELVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 493 - protein, 568 aa, Artificial sequence
  modified RSV sequnce
MELLILKANAITTILTAVTFCFASGQNITEEFYQSTCSAVSKGYLSALRTGWYTSLITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQFLPIMNKQSCSISNIETVIEFQQKLNRFLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 494 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQFLPIMNKQSCSISNIETVIEFQQKLNRFLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 495 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQFLPIMNKQSCSISNIETVIEFQQMLNRFLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 496 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVCLSNGVCVLTSKVLDLKNYIDKQFLPIINKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 497 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVFHLEGEVNKIKSALLSTNKAVVSLSNGVSVLTSKVLDLKNYIDKQFLPIINKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 498 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSHHHHHHSAWSHPQFEK

SEQ ID NO: 499 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDERDASISQVNEKINQSLAFIRKSDELLSAIGGYIPEAPRDGQAYVRKDGEWVLLSTFLGGLVPRGSHHHHHHSAWSHPQFEK

SEQ ID NO: 500 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 501 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 502 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTMKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 503 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSHHHHHHSAWSHPQFEK

SEQ ID NO: 504 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAWKRKFDELLGGLVPRGSHHHHHHSAWSHPQFEK

SEQ ID NO: 505 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSHHHHHHSAWSHPQFEK

SEQ ID NO: 506 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAWKRKFDELLGGLVPRGSHHHHHHSAWSHPQFEK

SEQ ID NO: 507 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDELLGGLVPRGSHHHHHHSAWSHPQFEK

SEQ ID NO: 508 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDELLGGLVPRGSHHHHHHSAWSHPQFEK

SEQ ID NO: 509 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDELLGGLVPRGSHHHHHHSAWSHPQFEK

SEQ ID NO: 510 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 511 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDECCGGLVPRGSHHHHHHSAWSHPQFEK

SEQ ID NO: 512 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDECCGGLVPRGSHHHHHHSAWSHPQFEK

SEQ ID NO: 513 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDECCGGLVPRGSHHHHHHSAWSHPQFEK

SEQ ID NO: 514 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWIRKSDELLGGLVPRGSHHHHHHSAWSHPQFEK

SEQ ID NO: 515 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAWIRKSDELLGGLVPRGSHHHHHHSAWSHPQFEK

SEQ ID NO: 516 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAWKRKSDELLGGLVPRGSHHHHHHSAWSHPQFEK

SEQ ID NO: 517 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDELLGGLVPRGSHHHHHHSAWSHPQFEK

SEQ ID NO: 518 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWIRKSDECCGGLVPRGSHHHHHHSAWSHPQFEK

SEQ ID NO: 519 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAWIRKSDECCGGLVPRGSHHHHHHSAWSHPQFEK

SEQ ID NO: 520 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAWKRKSDECCGGLVPRGSHHHHHHSAWSHPQFEK

SEQ ID NO: 521 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDECCGGLVPRGSHHHHHHSAWSHPQFEK

SEQ ID NO: 522 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKFDELLGGLVPRGSHHHHHHSAWSHPQFEK

SEQ ID NO: 523 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKFDELLGGLVPRGSHHHHHHSAWSHPQFEK

SEQ ID NO: 524 - protein, 537 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGFSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWKRKFDELLGGLVPRGSHHHHHHSAWSHPQFEK

SEQ ID NO: 525 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGLVPRGSHHHHHHSAWSHPQFEK

SEQ ID NO: 526 - protein, 537 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVFHLEGEVNKIKSALLSTNKAVVSLSNGFSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWKRKFDELLGGLVPRGSHHHHHHSAWSHPQFEK

SEQ ID NO: 527 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCECGGLVPRGSHHHHHHSAWSHPQFEK

SEQ ID NO: 528 - protein, 540 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCEECGGLVPRGSHHHHHHSAWSHPQFEK

SEQ ID NO: 529 - protein, 538 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECECGGLVPRGSHHHHHHSAWSHPQFEK

SEQ ID NO: 530 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECEECGGLVPRGSHHHHHHSAWSHPQFEK

SEQ ID NO: 531 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCECGGLVPRGSHHHHHHSAWSHPQFEK

SEQ ID NO: 532 - protein, 540 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCEECGGLVPRGSHHHHHHSAWSHPQFEK

SEQ ID NO: 533 - protein, 538 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECECGGLVPRGSHHHHHHSAWSHPQFEK

SEQ ID NO: 534 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECEECGGLVPRGSHHHHHHSAWSHPQFEK

SEQ ID NO: 535 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCECGGLVPRGSHHHHHHSAWSHPQFEK

SEQ ID NO: 536 - protein, 540 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCEECGGLVPRGSHHHHHHSAWSHPQFEK

SEQ ID NO: 537 - protein, 538 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECECGGLVPRGSHHHHHHSAWSHPQFEK

SEQ ID NO: 538 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECEECGGLVPRGSHHHHHHSAWSHPQFEK

SEQ ID NO: 539 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELCECGGLVPRGSHHHHHHSAWSHPQFEK

SEQ ID NO: 540 - protein, 540 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELCEECGGLVPRGSHHHHHHSAWSHPQFEK

SEQ ID NO: 541 - protein, 538 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECECGGLVPRGSHHHHHHSAWSHPQFEK

SEQ ID NO: 542 - protein, 539 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECEECGGLVPRGSHHHHHHSAWSHPQFEK

SEQ ID NO: 543 - protein, 537 aa, Artificial sequence; identical to SEQ ID NO: 510
  modified RSV sequnce

SEQ ID NO: 544 - protein, 516 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGLVPRGSHHHHHHSAWSHPQFEK

SEQ ID NO: 545 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSHHHHHHSAWSHPQFEK

SEQ ID NO: 546 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSHHHHHHSAWSHPQFEK

SEQ ID NO: 547 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSHHHHHHSAWSHPQFEK

SEQ ID NO: 548 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSHHHHHHSAWSHPQFEK

SEQ ID NO: 549 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSHHHHHHSAWSHPQFEK

SEQ ID NO: 550 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSHHHHHHSAWSHPQFEK

SEQ ID NO: 551 - protein, 537 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYCNKVECKVLYVKGEPIINFYDPLVFPSDEWDASISQVNEKINQSLAFIRKSDEKLHNVEDKIEEILSKIYHIENEIARIKKLIGEAGLVPRGSHHHHHHSAWSHPQFEK

SEQ ID NO: 552 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSGGYIPEAPRDGQAYVRKDGEWVLLSTFLGGHHHHHHSAWSHPQFEK

SEQ ID NO: 553 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAWKRKFDELLGGLVPRGSGGYIPEAPRDGQAYVRKDGEWVLLSTFLGGHHHHHHSAWSHPQFEK

SEQ ID NO: 554 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAFKRKFDELLGGLVPRGSGGYIPEAPRDGQAYVRKDGEWVLLSTFLGGHHHHHHSAWSHPQFEK

SEQ ID NO: 555 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSEAWKRKFDELLGGLVPRGSGGYIPEAPRDGQAYVRKDGEWVLLSTFLGGHHHHHHSAWSHPQFEK

SEQ ID NO: 556 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDELLGGLVPRGSGGYIPEAPRDGQAYVRKDGEWVLLSTFLGGHHHHHHSAWSHPQFEK

SEQ ID NO: 557 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDELLGGLVPRGSGGYIPEAPRDGQAYVRKDGEWVLLSTFLGGHHHHHHSAWSHPQFEK

SEQ ID NO: 558 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDELLGGLVPRGSGGYIPEAPRDGQAYVRKDGEWVLLSTFLGGHHHHHHSAWSHPQFEK

SEQ ID NO: 559 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSGGYIPEAPRDGQAYVRKDGEWVLLSTFLGGHHHHHHSAWSHPQFEK

SEQ ID NO: 560 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDECCGGLVPRGSGGYIPEAPRDGQAYVRKDGEWVLLSTFLGGHHHHHHSAWSHPQFEK

SEQ ID NO: 561 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDECCGGLVPRGSGGYIPEAPRDGQAYVRKDGEWVLLSTFLGGHHHHHHSAWSHPQFEK

SEQ ID NO: 562 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDECCGGLVPRGSGGYIPEAPRDGQAYVRKDGEWVLLSTFLGGHHHHHHSAWSHPQFEK

SEQ ID NO: 563 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWIRKSDELLGGLVPRGSGGYIPEAPRDGQAYVRKDGEWVLLSTFLGGHHHHHHSAWSHPQFEK

SEQ ID NO: 564 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAWIRKSDELLGGLVPRGSGGYIPEAPRDGQAYVRKDGEWVLLSTFLGGHHHHHHSAWSHPQFEK

SEQ ID NO: 565 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAWKRKSDELLGGLVPRGSGGYIPEAPRDGQAYVRKDGEWVLLSTFLGGHHHHHHSAWSHPQFEK

SEQ ID NO: 566 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDELLGGLVPRGSGGYIPEAPRDGQAYVRKDGEWVLLSTFLGGHHHHHHSAWSHPQFEK

SEQ ID NO: 567 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWIRKSDECCGGLVPRGSGGYIPEAPRDGQAYVRKDGEWVLLSTFLGGHHHHHHSAWSHPQFEK

SEQ ID NO: 568 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAWIRKSDECCGGLVPRGSGGYIPEAPRDGQAYVRKDGEWVLLSTFLGGHHHHHHSAWSHPQFEK

SEQ ID NO: 569 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAWKRKSDECCGGLVPRGSGGYIPEAPRDGQAYVRKDGEWVLLSTFLGGHHHHHHSAWSHPQFEK

SEQ ID NO: 570 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDECCGGLVPRGSGGYIPEAPRDGQAYVRKDGEWVLLSTFLGGHHHHHHSAWSHPQFEK

SEQ ID NO: 571 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKFDELLGGLVPRGSGGYIPEAPRDGQAYVRKDGEWVLLSTFLGGHHHHHHSAWSHPQFEK

SEQ ID NO: 572 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKFDELLGGLVPRGSGGYIPEAPRDGQAYVRKDGEWVLLSTFLGGHHHHHHSAWSHPQFEK

SEQ ID NO: 573 - protein, 567 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGFSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWKRKFDELLGGLVPRGSGGYIPEAPRDGQAYVRKDGEWVLLSTFLGGHHHHHHSAWSHPQFEK

SEQ ID NO: 574 - protein, 567 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGLVPRGSGGYIPEAPRDGQAYVRKDGEWVLLSTFLGGHHHHHHSAWSHPQFEK

SEQ ID NO: 575 - protein, 567 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVFHLEGEVNKIKSALLSTNKAVVSLSNGFSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWKRKFDELLGGLVPRGSGGYIPEAPRDGQAYVRKDGEWVLLSTFLGGHHHHHHSAWSHPQFEK

SEQ ID NO: 576 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCECGGLVPRGSGGYIPEAPRDGQAYVRKDGEWVLLSTFLGGHHHHHHSAWSHPQFEK

SEQ ID NO: 577 - protein, 570 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCEECGGLVPRGSGGYIPEAPRDGQAYVRKDGEWVLLSTFLGGHHHHHHSAWSHPQFEK

SEQ ID NO: 578 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECECGGLVPRGSGGYIPEAPRDGQAYVRKDGEWVLLSTFLGGHHHHHHSAWSHPQFEK

SEQ ID NO: 579 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECEECGGLVPRGSGGYIPEAPRDGQAYVRKDGEWVLLSTFLGGHHHHHHSAWSHPQFEK

SEQ ID NO: 580 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCECGGLVPRGSGGYIPEAPRDGQAYVRKDGEWVLLSTFLGGHHHHHHSAWSHPQFEK

SEQ ID NO: 581 - protein, 570 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCEECGGLVPRGSGGYIPEAPRDGQAYVRKDGEWVLLSTFLGGHHHHHHSAWSHPQFEK

SEQ ID NO: 582 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECECGGLVPRGSGGYIPEAPRDGQAYVRKDGEWVLLSTFLGGHHHHHHSAWSHPQFEK

SEQ ID NO: 583 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECEECGGLVPRGSGGYIPEAPRDGQAYVRKDGEWVLLSTFLGGHHHHHHSAWSHPQFEK

SEQ ID NO: 584 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCECGGLVPRGSGGYIPEAPRDGQAYVRKDGEWVLLSTFLGGHHHHHHSAWSHPQFEK

SEQ ID NO: 585 - protein, 570 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELCEECGGLVPRGSGGYIPEAPRDGQAYVRKDGEWVLLSTFLGGHHHHHHSAWSHPQFEK

SEQ ID NO: 586 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECECGGLVPRGSGGYIPEAPRDGQAYVRKDGEWVLLSTFLGGHHHHHHSAWSHPQFEK

SEQ ID NO: 587 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDECEECGGLVPRGSGGYIPEAPRDGQAYVRKDGEWVLLSTFLGGHHHHHHSAWSHPQFEK

SEQ ID NO: 588 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELCECGGLVPRGSGGYIPEAPRDGQAYVRKDGEWVLLSTFLGGHHHHHHSAWSHPQFEK

SEQ ID NO: 589 - protein, 570 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELCEECGGLVPRGSGGYIPEAPRDGQAYVRKDGEWVLLSTFLGGHHHHHHSAWSHPQFEK

SEQ ID NO: 590 - protein, 568 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECECGGLVPRGSGGYIPEAPRDGQAYVRKDGEWVLLSTFLGGHHHHHHSAWSHPQFEK

SEQ ID NO: 591 - protein, 569 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECEECGGLVPRGSGGYIPEAPRDGQAYVRKDGEWVLLSTFLGGHHHHHHSAWSHPQFEK

SEQ ID NO: 592 - protein, 567 aa, Artificial sequence; identical to SEQ ID NO: 559
  modified RSV sequnce

SEQ ID NO: 593 - protein, 546 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGLVPRGSGGYIPEAPRDGQAYVRKDGEWVLLSTFLGGHHHHHHSAWSHPQFEK

SEQ ID NO: 594 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 595 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 596 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 597 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 598 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 599 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 600 - protein, 567 aa, Artificial sequence
  modified RSV sequnce
MELLILKTNAITAILAAVTLCFASSQNITEEFYQSTCSAVSKGYLSALRTGWYTSVITIELSNIKENKCNGTDAKVKLIKQELDKYKSAVTELQLLMQSTPATNNKFLGFLLGVGSAIASGIAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYCNKVECKVLYVKGEPIINFYDPLVFPSDEWDASISQVNEKINQSLAFIRKSDEKLHNVEDKIEEILSKIYHIENEIARIKKLIGEAGLVPRGSGGYIPEAPRDGQAYVRKDGEWVLLSTFLGGHHHHHHSAWSHPQFEK

SEQ ID NO: 601 - protein, 537 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGLVPRGSHHHHHHSAWSHPQFEK

SEQ ID NO: 602 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 603 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 604 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 605 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 606 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 607 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 608 - protein, 679 aa, Artificial sequence
  modified RSV sequnce
MELLILKANAITTILTAVTFCFASGQNITEEFYQSTCSAVSKGYLSALRTGWYASVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVFHLEGEVNKIKSALLSTNKAVVSLSNGFSVLTFKVLDLKNYIDKQLLPILNKQSCSISNIETVIEFQQKNNRFLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKFMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 609 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQEFDKYKNAFTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFKRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 610 - protein, 685 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCECGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 611 - protein, 686 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELCEECGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 612 - protein, 684 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECECGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 613 - protein, 685 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECEECGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 614 - protein, 720 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 615 - protein, 720 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 616 - protein, 720 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 617 - protein, 720 aa, Artificial sequence
  modified RSV sequnce
MELLILKANAITTILTAVTFCFASGQNITEEFYQSTCSAVSKGYLSALRTGWYTSVITIELSNIKENKCNGTDAKVCLIKQELDKYKNAVTELQLLMQSTPATNNRARRELPRFMNYTLNNAKKTNVTLSKKRKRRFLGFLLGVGSAIASGVAVCKVLHLEGEVNKIKSACLSTNKAVVSLSNGVSVLTFCVLDLKNYIDKQLLPIVNKQSCSISNCETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTCSNKNRGIIKTFSNGCDYVSNKGVDTCSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 618 - protein, 641 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 619 - protein, 620 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 620 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSCWSYTHSLDGAGLFLFDHAAEEYEHAKKLIIFLNENNVPCQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 621 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWSYTHSLDGAGLFLFDHAAEEYEHAKKLIIFLNENNVPSQLTSISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 622 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVFHLEGEVNKIKSALLSTNKAVVSLSNGVSVLTFKVLDLKNYIDKQFLPILNKQSCSISNIETVIEFQQKNNRLLEITREFSVNAGVTTPVSTYMLTNSELLSLINDMPITNDQKKLMSNNVQIVRQQSYSIMCIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSCWSYTHSLDGAGLFLFDHAAEEYEHAKKLIIFLNENNVPCQLTSISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 623 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNFIDKQLLPILNKQSCSISNIELVIEFQQMNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 624 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQVLDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQMLNRLLEITREFSVNAGVTTPVSTYMLTNSELLSLINDMPITNDQKKLMSNNVQIVRQQSYSIMCIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWSYTHSLDGAGLFLFDHAAEEYEHAKKLIIFLNENNVPSQLTSISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 625 - protein, 689 aa, Artificial sequence
  modified RSV sequnce
MELLILKANAITTILTAVTFCFASGDYKDDDDKGGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 626 - protein, 688 aa, Artificial sequence
  modified RSV sequnce
MELLILKANAITTILTAVTFCFASGQHHHHHHGGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 627 - protein, 690 aa, Artificial sequence
  modified RSV sequnce
MELLILKANAITTILTAVTFCFASGQHHHHHHHHGGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 628 - protein, 689 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKGGHHHHHHGGEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 629 - protein, 691 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKGGHHHHHHHHGGEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 630 - protein, 679 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTHHHHHGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 631 - protein, 706 aa, Artificial sequence
  modified RSV sequnce
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 632 - protein, 706 aa, Artificial sequence; identical to SEQ ID NO: 631
  modified RSV sequnce

SEQ ID NO: 633 - protein, 684 aa, Artificial sequence
  modified RSV sequnce
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 634 - protein, 684 aa, Artificial sequence
  modified RSV sequence
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIQQSLAFIRKSDEGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 635 - protein, 647 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 636 - protein, 631 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGGGGGGGGGSGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 637 - protein, 641 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIQQSLAFIRKSDEGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 638 - protein, 647 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIQQSLAFIRKSDEGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 639 - protein, 644 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 640 - protein, 623 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 641 - protein, 652 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGGSGGSGSGSGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 642 - protein, 631 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGGSGGSGSGSGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 643 - protein, 644 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIQQSLAFIRKSDECCGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 644 - protein, 652 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIQQSLAFIRKSDECCGGGSGGSGSGSGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 645 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKINQSLAFIRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 646 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAFKRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 647 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAFKRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 648 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINFYDPLVFPSDEFDASISQVNEKIQQSLAFIRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 649 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKIQQSQAFKRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 650 - protein, 684 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKIQQSQAFKRKSDEGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 651 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQCYVRCDGEWVLLSTFLGGLVPRGSHHHHHHSAWSHPQFEK

SEQ ID NO: 652 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPECPRDGQAYVCKDGEWVLLSTFLGGLVPRGSHHHHHHSAWSHPQFEK

SEQ ID NO: 653 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQCYCRKDGEWVLLSTFLGGLVPRGSHHHHHHSAWSHPQFEK

SEQ ID NO: 654 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQACVRKDGECVLLSTFLGGLVPRGSHHHHHHSAWSHPQFEK

SEQ ID NO: 655 - protein, 585 aa, Artificial sequence
  modified RSV protein
MELLILKANAITTILTAVTFCFASGQNITEEFYQSTCSAVSKGYLSALRTGWYTSVITIELSNINETKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLNITNNQTCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGGLNDIFEAQKIEWHEGGLVPRGSHHHHHHSAWSHPQFEK

SEQ ID NO: 656 - protein, 585 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDTKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGGLNDIFEAQKIEWHEGGLVPRGSHHHHHHSAWSHPQFEK

SEQ ID NO: 657 - protein, 585 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITRDQKELMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGGLNDIFEAQKIEWHEGGLVPRGSHHHHHHSAWSHPQFEK

SEQ ID NO: 658 - protein, 568 aa, Artificial sequence
  modified RSV protein
MELLIHRLSAIFLTLAINALYLTSSQNITEEFYQSTCSAVSRGYFSALRTGWYTSVITIELSNINETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLNITNNQTCRISNIETVIEFQQKNSRLLEINREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 659 - protein, 568 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEINREFSVNAGVTTPLSTYMLTNSELLSLINDMPITNDTKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 660 - protein, 568 aa, Artificial sequence
  modified RSV protein
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEINREFSVNAGVTTPLSTYMLTNSELLSLINDMPITRDQKELMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 661 - protein, 568 aa, Artificial sequence
  modified RSV protein
MELLIHRLSAIFLTLAINALYLTSSQNITEEFYQSTCSAVSRGYFSALRTGWYTSVITIELSNINETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLNITNNQTCRISNIETVIEFQQKNSRLLEINREFSVNAGVTTPLSTYMLTNSELLSLINDMPITNDTKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 662 - protein, 568 aa, Artificial sequence
  modified RSV protein
MELLIHRLSAIFLTLAINALYLTSSQNITEEFYQSTCSAVSRGYFSALRTGWYTSVITIELSNINETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLNITNNQTCRISNIETVIEFQQKNSRLLEINREFSVNAGVTTPLSTYMLTNSELLSLINDMPITRDQKELMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 663 - protein, 585 aa, Artificial sequence
  modified RSV protein
MELLILKANAITTILTAVTFCFASGQNITEEFYQSTCSAVSKGYLSALRTGWYTSVITIELSNINETKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLNITNNQTCSISNIETVIEFQQKNNRLLEITREFSVNAGVTTPVSTYMLTNSELLSLINDMPITNDTKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGGLNDIFEAQKIEWHEGGLVPRGSHHHHHHSAWSHPQFEK

SEQ ID NO: 664 - protein, 585 aa, Artificial sequence
  modified RSV protein
MELLILKANAITTILTAVTFCFASGQNITEEFYQSTCSAVSKGYLSALRTGWYTSVITIELSNINETKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLNITNNQTCSISNIETVIEFQQKNNRLLEITREFSVNAGVTTPVSTYMLTNSELLSLINDMPITRDQKELMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGGLNDIFEAQKIEWHEGGLVPRGSHHHHHHSAWSHPQFEK

SEQ ID NO: 665 - protein, 494 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 666 - protein, 494 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWCGGLVPRGSHHHHHHSAWSHPQFEK

SEQ ID NO: 667 - protein, 473 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGLVPRGSHHHHHHSAWSHPQFEK

SEQ ID NO: 668 - protein, 473 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCWDASGGLVPRGSHHHHHHSAWSHPQFEK

SEQ ID NO: 669 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 670 - protein, 479 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGLVPRGSHHHHHHSAWSHPQFEK

SEQ ID NO: 671 - protein, 500 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 672 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFLSAIGGLVPRGSHHHHHHSAWSHPQFEK

SEQ ID NO: 673 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELFSAIGGLVPRGSHHHHHHSAWSHPQFEK

SEQ ID NO: 674 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFFSAIGGLVPRGSHHHHHHSAWSHPQFEK

SEQ ID NO: 675 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEYYSAIGGLVPRGSHHHHHHSAWSHPQFEK

SEQ ID NO: 676 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFYSAIGGLVPRGSHHHHHHSAWSHPQFEK

SEQ ID NO: 677 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWWSAIGGLVPRGSHHHHHHSAWSHPQFEK

SEQ ID NO: 678 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWYSAIGGLVPRGSHHHHHHSAWSHPQFEK

SEQ ID NO: 679 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDELLSAIGGLVPRGSHHHHHHSAWSHPQFEK

SEQ ID NO: 680 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELLSAIGGLVPRGSHHHHHHSAWSHPQFEK

SEQ ID NO: 681 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFLSAIGGLVPRGSHHHHHHSAWSHPQFEK

SEQ ID NO: 682 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFFSAIGGLVPRGSHHHHHHSAWSHPQFEK

SEQ ID NO: 683 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFLSAIGGLVPRGSGGYIPEAPRDGQAYVRKDGEWVLLSTFLGGHHHHHHSAWSHPQFEK

SEQ ID NO: 684 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELFSAIGGLVPRGSGGYIPEAPRDGQAYVRKDGEWVLLSTFLGGHHHHHHSAWSHPQFEK

SEQ ID NO: 685 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFFSAIGGLVPRGSGGYIPEAPRDGQAYVRKDGEWVLLSTFLGGHHHHHHSAWSHPQFEK

SEQ ID NO: 686 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEYYSAIGGLVPRGSGGYIPEAPRDGQAYVRKDGEWVLLSTFLGGHHHHHHSAWSHPQFEK

SEQ ID NO: 687 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFYSAIGGLVPRGSGGYIPEAPRDGQAYVRKDGEWVLLSTFLGGHHHHHHSAWSHPQFEK

SEQ ID NO: 688 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWWSAIGGLVPRGSGGYIPEAPRDGQAYVRKDGEWVLLSTFLGGHHHHHHSAWSHPQFEK

SEQ ID NO: 689 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWYSAIGGLVPRGSGGYIPEAPRDGQAYVRKDGEWVLLSTFLGGHHHHHHSAWSHPQFEK

SEQ ID NO: 690 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDELLSAIGGLVPRGSGGYIPEAPRDGQAYVRKDGEWVLLSTFLGGHHHHHHSAWSHPQFEK

SEQ ID NO: 691 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELLSAIGGLVPRGSGGYIPEAPRDGQAYVRKDGEWVLLSTFLGGHHHHHHSAWSHPQFEK

SEQ ID NO: 692 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFLSAIGGLVPRGSGGYIPEAPRDGQAYVRKDGEWVLLSTFLGGHHHHHHSAWSHPQFEK

SEQ ID NO: 693 - protein, 570 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFFSAIGGLVPRGSGGYIPEAPRDGQAYVRKDGEWVLLSTFLGGHHHHHHSAWSHPQFEK

SEQ ID NO: 694 - protein, 26 aa, Artificial sequence
  modified Foldon domain
GYIPEAPRDGQCYVRCDGEWVLLSTF

SEQ ID NO: 695 - protein, 26 aa, Artificial sequence
  modified Foldon domain
GYIPECPRDGQAYVCKDGEWVLLSTF

SEQ ID NO: 696 - protein, 26 aa, Artificial sequence
  modified foldon domain
GYIPEAPRDGQCYCRKDGEWVLLSTF

SEQ ID NO: 697 - protein, 26 aa, Artificial sequence
  modified foldon domain
GYIPEAPRDGQACVRKDGECVLLSTF

SEQ ID NO: 698 - protein, 530 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 699 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 700 - protein, 532 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGQGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 701 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 702 - protein, 533 aa, Artificial sequence; identical to SEQ ID NO: 701
  modified RSV protein

SEQ ID NO: 703 - protein, 535 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGSGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 704 - protein, 536 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGSGGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 705 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGSGGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 706 - protein, 527 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 707 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 708 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGKSTTGGLVPRGSGGYIPEAPRDGQAYVRKDGEWVLLSTFLGGHHHHHHSAWSHPQFEK

SEQ ID NO: 709 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPCDEFDASISCVNEKINQSLAFIRKSDELLSAIGGLVPRGSGGYIPEAPRDGQAYVRKDGEWVLLSTFLGGHHHHHHSAWSHPQFEK

SEQ ID NO: 710 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTGGLVPRGSGGYIPEAPRDGQAYVRKDGEWVLLSTFLGGHHHHHHSAWSHPQFEK

SEQ ID NO: 711 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQCTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVCSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 712 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQCTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKCQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 713 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVCVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNCQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 714 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPCTNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCCVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 715 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 716 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTGGLVPRGSGGYIPEAPRDGQAYVRKDGEWVLLSTFLGGHHHHHHSAWSHPQFEK

SEQ ID NO: 717 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 718 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 719 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 720 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 721 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 722 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 723 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 724 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 725 - protein, 677 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 726 - protein, 692 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNKKLSTVNKMLTTVISGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 727 - protein, 692 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGLSTVNKMLTTVISGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 728 - protein, 681 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPSAPSGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 729 - protein, 711 aa, Artificial sequence
  modified RSV protein
MELLILKANAITTILTAVTFCFASGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 730 - protein, 674 aa, Artificial sequence
  modified RSV protein
MYSMQLASCVTLTLVLLVNSEGQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 731 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 732 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 733 - protein, 531 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 734 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 735 - protein, 531 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 736 - protein, 531 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 737 - protein, 531 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 738 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 739 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 740 - protein, 518 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNKKLSTVNKMLTTVIGGLVPRGSHHHHHHSAWSHPQFEK

SEQ ID NO: 741 - protein, 518 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGLSTVNKMLTTVIGGLVPRGSHHHHHHSAWSHPQFEK

SEQ ID NO: 742 - protein, 526 aa, Artificial sequence
  modified RSV protein
MYSMQLASCVTLTLVLLVNSQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 743 - protein, 526 aa, Artificial sequence; identical to SEQ ID NO: 742
  modified RSV protein

SEQ ID NO: 744 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDCKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNICTVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 745 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSCSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVCKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 746 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAICSGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 747 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRCLPSEVNLCNVDIFNPKYDCKIMTSKTDVSSSVITSLGAIVSCYGKTKCTASNKNRGIIKTFSNGCDYVSNKGVDTVSVGCTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 748 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDCKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 749 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSCSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVCKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 750 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAICSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 751 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRCLPSEVNLCNVDIFNPKYDCKIMTSKTDVSSSVITSLGAIVSCYGKTKCTASNKNRGIIKTFSNGCDYVSNKGVDTVSVGCTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 752 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPCDEFDASISCVNEKINQSLAFIRKSDELLSAIGGLVPRGSGGYIPEAPRDGQAYVRKDGEWVLLSTFLGGHHHHHHSAWSHPQFEK

SEQ ID NO: 753 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTGGLVPRGSGGYIPEAPRDGQAYVRKDGEWVLLSTFLGGHHHHHHSAWSHPQFEK

SEQ ID NO: 754 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQCTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 755 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQCTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKCQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 756 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVCVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNCQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 757 - protein, 533 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPCTNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCCVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGLVPRGSGGYIPEAPRDGQAYVRKDGEWVLLSTFLGGHHHHHHSAWSHPQFEK

SEQ ID NO: 758 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNWETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 759 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVWEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 760 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSFEWDASISQVNEKINQSLAFIRKSDELLSAIGGYIPEAPRDGQAYVRKDGEWVLLSTFLGGHHHHHHSAWSHPQFEK

SEQ ID NO: 761 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKFDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 762 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNFQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 763 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKKIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFDQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 764 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNWETVWEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 765 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKFIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNWETVWEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 766 - protein, 543 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 767 - protein, 544 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 768 - protein, 545 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 769 - protein, 544 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSHHHHHHSAWSHPQFEK

SEQ ID NO: 770 - protein, 543 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPAAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 771 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 772 - protein, 542 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGGGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSHHHHHHSAWSHPQFEK

SEQ ID NO: 773 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNGGGGGGGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLSAIGGYIPEAPRDGQAYVRKDGEWVLLSTFLGGLVPRGSHHHHHHSAWSHPQFEK

SEQ ID NO: 774 - protein, 528 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPAGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 775 - protein, 527 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 776 - protein, 526 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 777 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 778 - protein, 524 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 779 - protein, 523 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 780 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 781 - protein, 532 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGGSGGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 782 - protein, 534 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGGSGGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 783 - protein, 532 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGGSGNGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 784 - protein, 527 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPANGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 785 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLISSTSATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 786 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLVTSTSATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 787 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLNSALSATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 788 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLISSTTSTGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 789 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLVTSTTSTGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 790 - protein, 529 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLNSALSSTGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 791 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLISSTSATVGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 792 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLVTSTSATTGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 793 - protein, 530 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLNSALSATGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 794 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLISSTTSTVGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 795 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLVTSTTSTTGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 796 - protein, 530 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLNSALSSTGGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 797 - protein, 644 aa, Artificial sequence
  modified RSV protein
MGWSCIILFLVATATGVHSGGSWSHPQFEKGGSHHHHHHLVPRGSQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSCPCFDASGGSGGSGGSGGSGSAMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 798 - protein, 643 aa, Artificial sequence
  modified RSV protein
MGWSCIILFLVATATGVHSGGSWSHPQFEKGGSHHHHHHLVPRGSQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASGGSGGSGGSGGSGSAMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 799 - protein, 664 aa, Artificial sequence
  modified RSV protein
MGWSCIILFLVATATGVHSGGSWSHPQFEKGGSHHHHHHVPRGSQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGSGGSGGSGGSGSAMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 800 - protein, 665 aa, Artificial sequence
  modified RSV protein
MGWSCIILFLVATATGVHSGGSWSHPQFEKGGSHHHHHHLVPRGSQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDESSGGSGGSGGSGGSGSAMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 801 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNSEKSELPRFMNYTLNNAKKTNVTLSSEKSGSFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 802 - protein, 568 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNSEKSEAPQYMNYTINTTKNLNVSISSEKSGSFLGFLLGVGSAIASGIAVSKVLHLEGEVNKIKNALLSTNKAVVSLSNGVSVLTSKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 803 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNSEKSELPRFMNYTLNNAKKTNVTLSSEKSGSFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 804 - protein, 568 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNSEKSEAPQYMNYTINTTKNLNVSISSEKSGSFLGFLLGVGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 805 - protein, 542 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNSEKSELPRFMNYTLNNAKKTNVTLSSEKSGSFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGGGLVPRGSHHHHHHSAWSHPQFEK

SEQ ID NO: 806 - protein, 542 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNSEKSEAPQYMNYTINTTKNLNVSISSEKSGSFLGFLLGVGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGGGLVPRGSHHHHHHSAWSHPQFEK

SEQ ID NO: 807 - protein, 564 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNSEKSELPRFMNYTLNNAKKTNVTLSSEKSGSFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLDKIEEILSKIYHIENEIARIKKLIGEAGGLVPRGSHHHHHHSAWSHPQFEK

SEQ ID NO: 808 - protein, 564 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNSEKSEAPQYMNYTINTTKNLNVSISSEKSGSFLGFLLGVGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLDKIEEILSKIYHIENEIARIKKLIGEAGGLVPRGSHHHHHHSAWSHPQFEK

SEQ ID NO: 809 - protein, 531 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNQGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 810 - protein, 679 aa, Artificial sequence
  modified RSV protein
MPMGSLQPLATLYLLGMLVASVLAQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 811 - protein, 527 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 812 - protein, 529 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

SEQ ID NO: 813 - protein, 527 aa, Artificial sequence; identical to SEQ ID NO: 811
  modified RSV protein

SEQ ID NO: 814 - protein, 529 aa, Artificial sequence; identical to SEQ ID NO: 812
  modified RSV protein

SEQ ID NO: 815 - protein, 534 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTGGYIPEAPRDGQAYVRKDGEWVLLSTFLGGLVPRGSHHHHHHSAWSHPQFEK

SEQ ID NO: 816 - protein, 536 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTGGYIPEAPRDGQAYVRKDGEWVLLSTFLGGLVPRGSHHHHHHSAWSHPQFEK

SEQ ID NO: 817 - protein, 534 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTGGYIPEAPRDGQAYVRKDGEWVLLSTFLGGLVPRGSHHHHHHSAWSHPQFEK

SEQ ID NO: 818 - protein, 536 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTGGYIPEAPRDGQAYVRKDGEWVLLSTFLGGLVPRGSHHHHHHSAWSHPQFEK

SEQ ID NO: 819 - protein, 534 aa, Artificial sequence; identical to SEQ ID NO: 817
  modified RSV protein

SEQ ID NO: 820 - protein, 536 aa, Artificial sequence; identical to SEQ ID NO: 818
  modified RSV protein

SEQ ID NO: 821 - protein, 536 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTGGLVPRGSGGYIPEAPRDGQAYVRKDGEWVLLSTFLGGHHHHHHSAWSHPQFEK

SEQ ID NO: 822 - protein, 538 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTGGLVPRGSGGYIPEAPRDGQAYVRKDGEWVLLSTFLGGHHHHHHSAWSHPQFEK

SEQ ID NO: 823 - protein, 536 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTGGLVPRGSGGYIPEAPRDGQAYVRKDGEWVLLSTFLGGHHHHHHSAWSHPQFEK

SEQ ID NO: 824 - protein, 538 aa, Artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAAGSGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTGGLVPRGSGGYIPEAPRDGQAYVRKDGEWVLLSTFLGGHHHHHHSAWSHPQFEK

SEQ ID NO: 825 - protein, 536 aa, Artificial sequence; identical to SEQ ID NO: 823
  modified RSV protein

SEQ ID NO: 826 - protein, 538 aa, Artificial sequence; identical to SEQ ID NO: 824
  modified RSV protein

SEQ ID NO: 827 - protein, 651 aa, Artificial sequence
  modified RSV protein
QSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 828 - protein, 653 aa, Artificial sequence
  modified RSV protein
QSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 829 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNAGLSTVNIMLTTVIGGLVPRGSHHHHHHSAWSHPQFEK

SEQ ID NO: 830 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNAGLSTVNKMLTTVIGGLVPRGSHHHHHHSAWSHPQFEK

SEQ ID NO: 831 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNKKLSTVNKMLTTVIGGLVPRGSHHHHHHSAWSHPQFEK

SEQ ID NO: 832 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECCHNVNAGLSTVNKMLTTVIGGLVPRGSHHHHHHSAWSHPQFEK

SEQ ID NO: 833 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNACCSTVNKMLTTVIGGLVPRGSHHHHHHSAWSHPQFEK

SEQ ID NO: 834 - protein, 555 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNAGLSTVNKCCTTVIGGLVPRGSHHHHHHSAWSHPQFEK

SEQ ID NO: 835 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNVNAGLSTVNKMLTTVIKCCGGLVPRGSHHHHHHSAWSHPQFEK

SEQ ID NO: 836 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIEDKIEEILSKQYHIENEIARCCGGLVPRGSHHHHHHSAWSHPQFEK

SEQ ID NO: 837 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDECCDKIEEILSKQYHIENEIARIKGGLVPRGSHHHHHHSAWSHPQFEK

SEQ ID NO: 838 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEFQNAVESTINTLQTTLEAVAQAIGGLVPRGSHHHHHHSAWSHPQFEK

SEQ ID NO: 839 - protein, 575 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGKSGGLVPRGSGGYIPEAPRDGQAYVRKDGEWVLLSTFLGGHHHHHHSAWSHPQFEK

SEQ ID NO: 840 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGKSTTNIMITTGGLVPRGSGGYIPEAPRDGQAYVRKDGEWVLLSTFLGGHHHHHHSAWSHPQFEK

SEQ ID NO: 841 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNIMITTGGLVPRGSGGYIPEAPRDGQAYVRKDGEWVLLSTFLGGHHHHHHSAWSHPQFEK

SEQ ID NO: 842 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNICCTTGGLVPRGSGGYIPEAPRDGQAYVRKDGEWVLLSTFLGGHHHHHHSAWSHPQFEK

SEQ ID NO: 843 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNCCITTGGLVPRGSGGYIPEAPRDGQAYVRKDGEWVLLSTFLGGHHHHHHSAWSHPQFEK

SEQ ID NO: 844 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGKSTTNGGLVPRGSGGYIPEAPRDGQAYVRKDGEWVLLSTFLGGHHHHHHSAWSHPQFEK

SEQ ID NO: 845 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNGGLVPRGSGGYIPEAPRDGQAYVRKDGEWVLLSTFLGGHHHHHHSAWSHPQFEK

SEQ ID NO: 846 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNGGLVPRGSGGYIPEAPRDGQAYVRKDGEWVLLSTFLGGHHHHHHSAWSHPQFEK

SEQ ID NO: 847 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTGGLVPRGSGGYIPEAPRDGQAYVRKDGEWVLLSTFLGGHHHHHHSAWSHPQFEK

SEQ ID NO: 848 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNIMITTGGLVPRGSGGYIPEAPRDGQAYVRKDGEWVLLSTFLGGHHHHHHSAWSHPQFEK

SEQ ID NO: 849 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNGGLVPRGSGGYIPEAPRDGQAYVRKDGEWVLLSTFLGGHHHHHHSAWSHPQFEK

SEQ ID NO: 850 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPCDEFDASISCVNEKINQSLAFIRKSDECCHNVNAGKSTTNGGLVPRGSGGYIPEAPRDGQAYVRKDGEWVLLSTFLGGHHHHHHSAWSHPQFEK

SEQ ID NO: 851 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPCDEFDASISCVNEKINQSLAFIRKSDECCHNVNACCSTTNGGLVPRGSGGYIPEAPRDGQAYVRKDGEWVLLSTFLGGHHHHHHSAWSHPQFEK

SEQ ID NO: 852 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPCDEFDASISCVNEKINQSQAWKRKSDECCHNVNACCSTTNGGLVPRGSGGYIPEAPRDGQAYVRKDGEWVLLSTFLGGHHHHHHSAWSHPQFEK

SEQ ID NO: 853 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPCDEFDASISCVNEKINQSLAFIRKSDECCHNVNACCSTTNICCTTGGLVPRGSGGYIPEAPRDGQAYVRKDGEWVLLSTFLGGHHHHHHSAWSHPQFEK

SEQ ID NO: 854 - protein, 583 aa, Artificial sequence; identical to SEQ ID NO: 853
  modified RSV protein

SEQ ID NO: 855 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDECCHNVNACCSTTNICCTTGGLVPRGSGGYIPEAPRDGQAYVRKDGEWVLLSTFLGGHHHHHHSAWSHPQFEK

SEQ ID NO: 856 - protein, 578 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDECCHNVNACCSTTNGGLVPRGSGGYIPEAPRDGQAYVRKDGEWVLLSTFLGGHHHHHHSAWSHPQFEK

SEQ ID NO: 857 - protein, 583 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGSIKTFSNGCDYVSNKGVDTVSVGNTLYYVNKQEGKSQYVKGEPIINKYDPQKFPSDEFDASISQVNEKINQSQAWKRKSDECCHNVNAGKSTTNICCTTGGLVPRGSGGYIPEAPRDGQAYVRKDGEWVLLSTFLGGHHHHHHSAWSHPQFEK

SEQ ID NO: 858 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDECCSAIGGGLVPRGSHHHHHHSAWSHPQFEK

SEQ ID NO: 859 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDECCSAIGGGLVPRGSHHHHHHSAWSHPQFEK

SEQ ID NO: 860 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFCECIGGGLVPRGSHHHHHHSAWSHPQFEK

SEQ ID NO: 861 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDELCECIGGGLVPRGSHHHHHHSAWSHPQFEK

SEQ ID NO: 862 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELCECIGGGLVPRGSHHHHHHSAWSHPQFEK

SEQ ID NO: 863 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFCECIGGGLVPRGSHHHHHHSAWSHPQFEK

SEQ ID NO: 864 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFCEECGGGLVPRGSHHHHHHSAWSHPQFEK

SEQ ID NO: 865 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDELCEECGGGLVPRGSHHHHHHSAWSHPQFEK

SEQ ID NO: 866 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELCEECGGGLVPRGSHHHHHHSAWSHPQFEK

SEQ ID NO: 867 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFCEECGGGLVPRGSHHHHHHSAWSHPQFEK

SEQ ID NO: 868 - protein, 539 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECECGGGLVPRGSHHHHHHSAWSHPQFEK

SEQ ID NO: 869 - protein, 540 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECEECGGGLVPRGSHHHHHHSAWSHPQFEK

SEQ ID NO: 870 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSCCGGGLVPRGSHHHHHHSAWSHPQFEK

SEQ ID NO: 871 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDETESAIGGGLVPRGSHHHHHHSAWSHPQFEK

SEQ ID NO: 872 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDETESCCGGGLVPRGSHHHHHHSAWSHPQFEK

SEQ ID NO: 873 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDESESAIGGGLVPRGSHHHHHHSAWSHPQFEK

SEQ ID NO: 874 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDESESCCGGGLVPRGSHHHHHHSAWSHPQFEK

SEQ ID NO: 875 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDESDSAIGGGLVPRGSHHHHHHSAWSHPQFEK

SEQ ID NO: 876 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDESDSCCGGGLVPRGSHHHHHHSAWSHPQFEK

SEQ ID NO: 877 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFLSCCGGGLVPRGSHHHHHHSAWSHPQFEK

SEQ ID NO: 878 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELFSCCGGGLVPRGSHHHHHHSAWSHPQFEK

SEQ ID NO: 879 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFFSCCGGGLVPRGSHHHHHHSAWSHPQFEK

SEQ ID NO: 880 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEYYSCCGGGLVPRGSHHHHHHSAWSHPQFEK

SEQ ID NO: 881 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEFYSCCGGGLVPRGSHHHHHHSAWSHPQFEK

SEQ ID NO: 882 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWWSCCGGGLVPRGSHHHHHHSAWSHPQFEK

SEQ ID NO: 883 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDEWYSCCGGGLVPRGSHHHHHHSAWSHPQFEK

SEQ ID NO: 884 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDELLSCCGGGLVPRGSHHHHHHSAWSHPQFEK

SEQ ID NO: 885 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDELLSCCGGGLVPRGSHHHHHHSAWSHPQFEK

SEQ ID NO: 886 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFLSCCGGGLVPRGSHHHHHHSAWSHPQFEK

SEQ ID NO: 887 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEFFSCCGGGLVPRGSHHHHHHSAWSHPQFEK

SEQ ID NO: 888 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKFDEAASCCGGGLVPRGSHHHHHHSAWSHPQFEK

SEQ ID NO: 889 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKWDEAASCCGGGLVPRGSHHHHHHSAWSHPQFEK

SEQ ID NO: 890 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWWRKFDECCSAIGGGLVPRGSHHHHHHSAWSHPQFEK

SEQ ID NO: 891 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWWRKFDELLSCCGGGLVPRGSHHHHHHSAWSHPQFEK

SEQ ID NO: 892 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWWRKFDESESCCGGGLVPRGSHHHHHHSAWSHPQFEK

SEQ ID NO: 893 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWWRKFDEAASCCGGGLVPRGSHHHHHHSAWSHPQFEK

SEQ ID NO: 894 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKFDECCSAIGGGLVPRGSHHHHHHSAWSHPQFEK

SEQ ID NO: 895 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKFDELLSCCGGGLVPRGSHHHHHHSAWSHPQFEK

SEQ ID NO: 896 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKSDECCSAIGGGLVPRGSHHHHHHSAWSHPQFEK

SEQ ID NO: 897 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKSDELLSCCGGGLVPRGSHHHHHHSAWSHPQFEK

SEQ ID NO: 898 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKSDEAASCCGGGLVPRGSHHHHHHSAWSHPQFEK

SEQ ID NO: 899 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKSDESESCCGGGLVPRGSHHHHHHSAWSHPQFEK

SEQ ID NO: 900 - protein, 541 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKDRKSDESDSCCGGGLVPRGSHHHHHHSAWSHPQFEK

SEQ ID NO: 901 - protein, 568 aa, Artificial sequence; identical to SEQ ID NO: 433
  modified RSV protein

SEQ ID NO: 902 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTLKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 903 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTRKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 904 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTEKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 905 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTAKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 906 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTQKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 907 - protein, 568 aa, Artificial sequence; identical to SEQ ID NO: 432
  modified RSV protein

SEQ ID NO: 908 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTGKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 909 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTPKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 910 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 911 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTTKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 912 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTCKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 913 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTVKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 914 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTDKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 915 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTNKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 916 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTHKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 917 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTKKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 918 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTSKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 919 - protein, 568 aa, Artificial sequence; identical to SEQ ID NO: 374
  modified RSV protein

SEQ ID NO: 920 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIGNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 921 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIANKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 922 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPISNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 923 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPITNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 924 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPICNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 925 - protein, 568 aa, Artificial sequence; identical to SEQ ID NO: 500
  modified RSV protein

SEQ ID NO: 926 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIINKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 927 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIMNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 928 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIPNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 929 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIFNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 930 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIYNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 931 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIWNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 932 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIDNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 933 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIENKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 934 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPINNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 935 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIQNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 936 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIHNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 937 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIKNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 938 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIRNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 939 - protein, 568 aa, Artificial sequence; identical to SEQ ID NO: 397
  modified RSV protein

SEQ ID NO: 940 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIELVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 941 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 942 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQMNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 943 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQLNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 944 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKMLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 945 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 946 - protein, 568 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 947 - protein, 568 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKFLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 948 - protein, 568 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKMLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 949 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKMKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 950 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKMKSALLSTNKAVVSMSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 951 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYFDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 952 - protein, 568 aa, Artificial sequence
  modified RSV protein
MELLILKANAITTILTAVTFCFASGQNITEEFYQSTCSAVSKGYLSALRTGWYTSVCTIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTCKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 953 - protein, 568 aa, Artificial sequence
  modified RSV protein
MELLILKANAITTILTAVTFCFASGQNITEEFYQSTCSAVSKGYLSALRTGWYTSVILIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 954 - protein, 568 aa, Artificial sequence
  modified RSV protein
MELLILKANAITTILTAVTFCFASGQNITEEFYQSTCSAVSKGYLSALRTGWYTSVIMIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 955 - protein, 568 aa, Artificial sequence
  modified RSV protein
MELLILKANAITTILTAVTFCFASGQNITEEFYQSTCSAVSKGYLSALRTGWYTSVIMIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 956 - protein, 568 aa, Artificial sequence
  modified RSV protein
MELLILKANAITTILTAVTFCFASGQNITEEFYQSTCSAVSKGYLSALRTGWYTSVIMIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLLYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 957 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKCGLDLKNYIDKQLLPIVNKQSCSISNIETVIEFQQKNNRLLEITREFSVNAGVTTPVSTYMLTNSCLLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 958 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINKYDPQKFPSDEFDASISQVNEKINQSQAWKRKFDELLGGLVPRGSHHHHHHSAWSHPQFEK

SEQ ID NO: 959 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAWIRKFDELLGGLVPRGSHHHHHHSAWSHPQFEK

SEQ ID NO: 960 - protein, 568 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLIYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 961 - protein, 568 aa, Artificial sequence
  modified RSV protein
MELLILKANAITTILTAVTFCFASGQNITEEFYQSTCSAVSKGYLSALRTGWYTSVIMIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 962 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVLSLSNGVSVLFSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 963 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKFLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 964 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKFLDLKNYIDKQLLPIVNKQSCSISNIETVIEFQQKNNRLLEITREFSVNAGVTTPVSTYMATNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 965 - protein, 568 aa, Artificial sequence
  modified RSV protein
MELLILKANAITTILTAVTFCFASGQNITEEFYQSTCSAVSKGYLSALRTGWYTSMITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKMKSALLSTNKAVVSMSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 966 - protein, 568 aa, Artificial sequence
  modified RSV protein
MELLILKANAITTILTAVTFCFASGQNITEEFYQSTCSAVSKGYLSALRTGWYTSMITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKMKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEMLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 967 - protein, 568 aa, Artificial sequence
  modified RSV protein
MELLILKANAITTILTAVTFCFASGQNITEEFYQSTCSAVSKGYLSALRTGWYTSMITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSFSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 968 - protein, 568 aa, Artificial sequence
  modified RSV protein
MELLILKANAITTILTAVTFCFASGQNITEEFYQSTCSAVSKGYLSALRTGCYTSVITIELSNIKENKCNGTDAKVKLIKQELDKYKNAVTELQLLMQSTPATNNRARRELPRFMNYTLNNAKKTNVTLSKKRKRRFLGFLLGVGSAIACGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 969 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRCLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDCGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKFIRKSDELLSAIGGYIPEAPRDGQAYVRKDGEWVLLSTFLGGLVPRGSHHHHHHSAWSHPQFEK

SEQ ID NO: 970 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRCLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRCDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKFIRKSDELLSAIGGYIPEAPRDGQAYVRKDGEWVLLSTFLGGLVPRGSHHHHHHSAWSHPQFEK

SEQ ID NO: 971 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLCFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPCAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKFIRKSDELLSAIGGYIPEAPRDGQAYVRKDGEWVLLSTFLGGLVPRGSHHHHHHSAWSHPQFEK

SEQ ID NO: 972 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRCLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRCDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKFIRKSDELLSAIGGYIPEAPRDGQAYVRKDGEWVLLSTFLGGLVPRGSHHHHHHSAWSHPQFEK

SEQ ID NO: 973 - protein, 569 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLCFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPCAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAKFIRKSDELLSAIGGYIPEAPRDGQAYVRKDGEWVLLSTFLGGLVPRGSHHHHHHSAWSHPQFEK

SEQ ID NO: 974 - protein, 569 aa, Artificial sequence; identical to SEQ ID NO: 973
  modified RSV protein

SEQ ID NO: 975 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSFINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 976 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSWINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 977 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSYINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 978 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSRINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 979 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVFTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 980 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVWTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 981 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVYTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 982 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVRTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 983 - protein, 568 aa, Artificial sequence
  modified RSV protein
MELLILKANAITTILTAVTFCFASGQNITEEFYQSTCSAVSKGYLSALRTGWYTSVFTIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 984 - protein, 568 aa, Artificial sequence
  modified RSV protein
MELLILKANAITTILTAVTFCFASGQNITEEFYQSTCSAVSKGYLSALRTGWYTSVWTIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 985 - protein, 568 aa, Artificial sequence
  modified RSV protein
MELLILKANAITTILTAVTFCFASGQNITEEFYQSTCSAVSKGYLSALRTGWYTSVRTIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 986 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMFTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 987 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMWTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 988 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMRTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 989 - protein, 568 aa, Artificial sequence; identical to SEQ ID NO: 963
  modified RSV protein

SEQ ID NO: 990 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKWLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 991 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKRLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 992 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIACGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 993 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAICSGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVCKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 994 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGCAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVCKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 995 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAICSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 996 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETFIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 997 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETWIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 998 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETMIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 999 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIEFVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1000 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIEMVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1001 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIEWVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1002 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIERVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1003 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVFEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1004 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVYEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1005 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVWEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1006 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKKIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFDQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1007 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNFQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1008 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVFIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1009 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQKTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNDVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1010 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVFSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1011 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDFSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1012 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKFDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1013 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKWDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1014 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSFEFDASISQVNEKINQSLAFIRKSDECCGGLVPRGSHHHHHHSAWSHPQFEK

SEQ ID NO: 1015 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSWEFDASISQVNEKINQSLAFIRKSDECCGGLVPRGSHHHHHHSAWSHPQFEK

SEQ ID NO: 1016 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNFETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1017 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNYETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1018 - protein, 537 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNWETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCGGLVPRGSHHHHHHSAWSHPQFEK

SEQ ID NO: 1019 - protein, 562 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTVKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1020 - protein, 562 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQLNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1021 - protein, 562 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1022 - protein, 562 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTVKVLDLKNYIDKQLLPILNKQSCSISNIETVIEFQQLNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1023 - protein, 562 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTVKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1024 - protein, 562 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQLNNRLLEITREFSVNAGVTTPVSTYMLTNSELLSLINDMPITNDQKKLMSNNVQIVRQQSYSIMCIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1025 - protein, 562 aa, Artificial sequence
  modified RSV protein
MELLILKANAITTILTAVTFCFASGQNITEEFYQSTCSAVSKGYLSALRTGWYTSVIIIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTVKVLDLKNYIDKQLLPILNKQSCSISNIETVIEFQQLNNRLLEITREFSVNAGVTTPVSTYMLTNSELLSLINDMPITNDQKKLMSNNVQIVRQQSYSIMCIIKEEVLMYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGHHHHHHSAWSHPQFEK

SEQ ID NO: 1026 - protein, 568 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1027 - protein, 135 aa, Artificial sequence
  modified RSV protein
MDSKGSSQKGSRLLLLLVVSNLLLPQGVVGQDLDLKNFIDKQLLPIMNKQSCSISNIELVIEFQQMNNRLLEAPGGELSNIKENKCNGTDAKVKLIKQELDKYKNAVAELQGGLVPRGSHHHHHHSAWSHPQFEK

SEQ ID NO: 1028 - protein, 135 aa, Artificial sequence
  modified RSV protein
MDSKGSSQKGSRLLLLLVVSNLLLPQGVVGQDLDLCNFIDKQLLPIMNKQSCSISNIELVIEFQQMNNRLLEAPGGCLSNIKENKCNGTDAKVKLIKQELDKYKNAVAELQGGLVPRGSHHHHHHSAWSHPQFEK

SEQ ID NO: 1029 - protein, 135 aa, Artificial sequence
  modified RSV protein
MDSKGSSQKGSRLLLLLVVSNLLLPQGVVGQDLCLKNFIDKQLLPIMNKQSCSISNIELVIEFQQMNNRLLEAPGGCLSNIKENKCNGTDAKVKLIKQELDKYKNAVAELQGGLVPRGSHHHHHHSAWSHPQFEK

SEQ ID NO: 1030 - protein, 135 aa, Artificial sequence
  modified RSV protein
MDSKGSSQKGSRLLLLLVVSNLLLPQGVVGQDLDLKNFIDKQLLPIMNKQSCSISNIELVIEFQQMNNRLLEAGSGELSNIKENKCNGTDAKVKLIKQELDKYKNAVAELQGGLVPRGSHHHHHHSAWSHPQFEK

SEQ ID NO: 1031 - protein, 135 aa, Artificial sequence
  modified RSV protein
MDSKGSSQKGSRLLLLLVVSNLLLPQGVVGQDLDLCNFIDKQLLPIMNKQSCSISNIELVIEFQQMNNRLLEAGSGCLSNIKENKCNGTDAKVKLIKQELDKYKNAVAELQGGLVPRGSHHHHHHSAWSHPQFEK

SEQ ID NO: 1032 - protein, 135 aa, Artificial sequence
  modified RSV protein
MDSKGSSQKGSRLLLLLVVSNLLLPQGVVGQDLCLKNFIDKQLLPIMNKQSCSISNIELVIEFQQMNNRLLEAGSGCLSNIKENKCNGTDAKVKLIKQELDKYKNAVAELQGGLVPRGSHHHHHHSAWSHPQFEK

SEQ ID NO: 1033 - protein, 131 aa, Artificial sequence
  modified RSV protein
MDSKGSSQKGSRLLLLLVVSNLLLPQGVVGQDLDLKNFIDKQLLPIMNKQSCSISNIELVIEFQQMNNRGSGELSNIKENKCNGTDAKVKLIKQELDKYKNAVAELQGGLVPRGSHHHHHHSAWSHPQFEK

SEQ ID NO: 1034 - protein, 131 aa, Artificial sequence
  modified RSV protein
MDSKGSSQKGSRLLLLLVVSNLLLPQGVVGQDLDLCNFIDKQLLPIMNKQSCSISNIELVIEFQQMNNRGSGCLSNIKENKCNGTDAKVKLIKQELDKYKNAVAELQGGLVPRGSHHHHHHSAWSHPQFEK

SEQ ID NO: 1035 - protein, 131 aa, Artificial sequence
  modified RSV protein
MDSKGSSQKGSRLLLLLVVSNLLLPQGVVGQDLCLKNFIDKQLLPIMNKQSCSISNIELVIEFQQMNNRGSGCLSNIKENKCNGTDAKVKLIKQELDKYKNAVAELQGGLVPRGSHHHHHHSAWSHPQFEK

SEQ ID NO: 1036 - protein, 152 aa, Artificial sequence
  modified RSV protein
MDSKGSSQKGSRLLLLLVVSNLLLPQGVVGQDNLSLCNYIDKQLLPILNKQSCSISNIETVIEFFFKNLRLLWICWESSVNAGNGSGSGGCLSNIKENKCNGTDAKVKLIKQELDKYKNCVTELQLLKGGLVPRGSHHHHHHSAWSHPQFEK

SEQ ID NO: 1037 - protein, 152 aa, Artificial sequence
  modified RSV protein
MDSKGSSQKGSRLLLLLVVSNLLLPQGVVGQDKLDLCNYIDKQLLPILNKQSCSISNRETVREFQQKNNRLLEICRESSVNAGGGSGSGGCLSNIKENKCNGTDAKVKLIKQELDKYKNCVTELQLRKGGLVPRGSHHHHHHSAWSHPQFEK

SEQ ID NO: 1038 - protein, 144 aa, Artificial sequence
  modified RSV protein
MDSKGSSQKGSRLLLLLVVSNLLLPQGVVGQDKLDLCNYIDKQLLPILNKQSCSISNRETVREFQQKNNRLLEICREGGGSGSGGCLSNIKENKCNGTDAKVKLIKQELDKYKNCVTELQGGLVPRGSHHHHHHSAWSHPQFEK

SEQ ID NO: 1039 - protein, 152 aa, Artificial sequence
  modified RSV protein
MDSKGSSQKGSRLLLLLVVSNLLLPQGVVGQDKLDLCNYIDKQLLPIVNKQSCSISNRETVREFQQKNNRLLEICRESSVNAGGGSGSGGCLSNIKENKCNGTDAKVKLIKQEFDKYKNCVTELQLRKGGLVPRGSHHHHHHSAWSHPQFEK

SEQ ID NO: 1040 - protein, 152 aa, Artificial sequence
  modified RSV protein
MDSKGSSQKGSRLLLLLVVSNLLLPQGVVGQDNLSLCNYIDKQLLPILNKQSCSISNNETVREFQNKTNRLLEICRNSSVNAGNGSGSGGCLSNIKENKCNGTDAKVKLIKQELDNYTNCVTNLSLRKGGLVPRGSHHHHHHSAWSHPQFEK

SEQ ID NO: 1041 - protein, 152 aa, Artificial sequence
  modified RSV protein
MDSKGSSQKGSRLLLLLVVSNLLLPQGVVGQDNLSLCNYIDKQLLPIVNKQSCSISNNETVREFQNKTNRLLEICRNSSVNAGNGSGSGGCLSNIKENKCNGTDAKVKLIKQEFDNYTNCVTNLSLRKGGLVPRGSHHHHHHSAWSHPQFEK

SEQ ID NO: 1042 - protein, 87 aa, Artificial sequence
  modified RSV protein
MPMGSLQPLATLYLLGMLVASVLAQSNIKENKCGGSGGGGSGGSGKNYIDKQLLPIVNKQSCQGGLVPRGSHHHHHHSAWSHPQFEK

SEQ ID NO: 1043 - protein, 87 aa, Artificial sequence
  modified RSV protein
MPMGSLQPLATLYLLGMLVASVLAQSNIKENKCGGSGGGGSGGSGKNYIDKQQLPITNKQSCQGGLVPRGSHHHHHHSAWSHPQFEK

SEQ ID NO: 1044 - protein, 87 aa, Artificial sequence
  modified RSV protein
MPMGSLQPLATLYLLGMLVASVLAQCNIKENKCGGSGGGGSGGSGCNYIDKQLLPIVNKQSCQGGLVPRGSHHHHHHSAWSHPQFEK

SEQ ID NO: 1045 - protein, 87 aa, Artificial sequence
  modified RSV protein
MPMGSLQPLATLYLLGMLVASVLAQCNIKENKCGGSGGGGSGGSGCNYIDKQQLPITNKQSCQGGLVPRGSHHHHHHSAWSHPQFEK

SEQ ID NO: 1046 - protein, 127 aa, Artificial sequence
  modified RSV protein
MRPTWAWWLFLVLLLALWAPARGQELSNIKENKCNGTDAKVKLIKQELDKYKNAVTELQGGSGGLDLKNYIDKQLLPIVNKQSCSISNIETVIEFQQKNNRLLEITREFGLEVLFQGPGHHHHHHHH

SEQ ID NO: 1047 - protein, 129 aa, Artificial sequence
  modified RSV protein
MRPTWAWWLFLVLLLALWAPARGQCELSNIKENKCNGTDAKVKLIKQELDKYKNAVTELQGGSGGLDCLKNYIDKQLLPIVNKQSCSISNIETVIEFQQKNNRLLEITREFGLEVLFQGPGHHHHHHHH

SEQ ID NO: 1048 - protein, 126 aa, Artificial sequence
  modified RSV protein
MRPTWAWWLFLVLLLALWAPARGQELSNIENKCNGTDAKVKLIKQELDKYKNAVTELQGGSGGLDLKNYIDKQLLPIVNKQSCSISNIETVIEFQQKNNRLLEITREFGLEVLFQGPGHHHHHHHH

SEQ ID NO: 1049 - protein, 127 aa, Artificial sequence
  modified RSV protein
MRPTWAWWLFLVLLLALWAPARGQELSNIKENKCNGTDAKVKSIKQELDKYKNAVTELQGGSGGLDLKNYIDKQLLPIVNKQSCSISNSETVSEFQQKNNRLLEITREFGLEVLFQGPGHHHHHHHH

SEQ ID NO: 1050 - protein, 129 aa, Artificial sequence
  modified RSV protein
MRPTWAWWLFLVLLLALWAPARGQCELSNIKENKCNGTDAKVKSIKQELDKYKNAVTELQGGSGGLDCLKNYIDKQLLPIVNKQSCSISNSETVSEFQQKNNRLLEITREFGLEVLFQGPGHHHHHHHH

SEQ ID NO: 1051 - protein, 133 aa, Artificial sequence
  modified RSV protein
MRPTWAWWLFLVLLLALWAPARGQLDLKNYIDKQLLPIVNKQSCGSGDAKVKLIKQELDKYKNAVTELQGGSGGELSNIKENKCNGTGSGSISNIETVIEFQQKNNRLLEITREFGLEVLFQGPGHHHHHHHH

SEQ ID NO: 1052 - protein, 133 aa, Artificial sequence
  modified RSV protein
MRPTWAWWLFLVLLLALWAPARGQLDLKNYIDKQLLPIVNKQSCGSGDAKVKQIKQELDKYKNAVTELQGGSGGELSNIKENKCNGTGSGSISNQETVNEFQQKNNRLLEITREFGLEVLFQGPGHHHHHHHH

SEQ ID NO: 1053 - protein, 139 aa, Artificial sequence
  modified RSV protein
MRPTWAWWLFLVLLLALWAPARGQELSNIKENKCNGTDAKGGNAERAKNVNGLLQVLMDINTLNGGSGGSGLDLKNYIDKQLLPIVNKQSCSISNIEGGKSSSKKEYMDSMNEKVAVMRNTGLEVLFQGPGHHHHHHHH

SEQ ID NO: 1054 - protein, 179 aa, Artificial sequence
  modified RSV protein
MELLILKANAITTILTAVTFCFASGQNDLKNYIDKQLLPQVNKQSCSISNQETVQEFQQKNNRFLEITSIEDAWARGEQTLDLSNTHIGLPYTINFSNLTQLRQPSGPMRSIRRTQQAPLSNIKENKCNGTDAKVKLIKQELDKYKNAVTELQLAGGLVPRGSHHHHHHSAWSHPQFEK

SEQ ID NO: 1055 - protein, 179 aa, Artificial sequence
  modified RSV protein
MELLILKANAITTILTAVTFCFASGQNDLCNYIDKQLLPQVNKQSCSISNQETVQEFQQKNNRFLEITSIEDAWARGEQTLDLSNTHIGLPYTINFSNLTQLRQPSGPMRSIRRTQQACLSNIKENKCNGTDAKVKLIKQELDKYKNAVTELQLAGGLVPRGSHHHHHHSAWSHPQFEK

SEQ ID NO: 1056 - protein, 179 aa, Artificial sequence
  modified RSV protein
MELLILKANAITTILTAVTFCFASGQNDLCNYIDKQLLPQVNKQSCSISNIETVQEFQQKNNRFLEITSIEDAWARGEQTLDLSNTHIGLPYTINFSNLTQLRQPSGPMRSIRRTQQACLSNIKENKCNGTDAKVKLIKQEFDKYKNAVTELQLAGGLVPRGSHHHHHHSAWSHPQFEK

SEQ ID NO: 1057 - protein, 228 aa, Artificial sequence
  modified RSV protein
MELLILKANAITTILTAVTFCFASGNDLKNYIDKQLLPQVNKQSCSISNQETVQEFQQKNNRFLEITREASELYASLDAKLRCNVTNLPSDSSLSVTWTREKSGNLRPDPMTLQEHQNGTYSASSAVPVSTQDWLSGERFTCTVQHEELPNPLSKSVYRNTGPTTPPELSNIKENKCNGTDAKVKLIKQELDKYKNAVTELQLGGGLVPRGSHHHHHHSAWSHPQFEK

SEQ ID NO: 1058 - protein, 228 aa, Artificial sequence
  modified RSV protein
MELLILKANAITTILTAVTFCFASGNDLCNYIDKQLLPQVNKQSCSISNQETVQEFQQKNNRFLEITREASELYASLDAKLRCNVTNLPSDSSLSVTWTREKSGNLRPDPMTLQEHQNGTYSASSAVPVSTQDWLSGERFTCTVQHEELPNPLSKSVYRNTGPTTPPCLSNIKENKCNGTDAKVKLIKQELDKYKNAVTELQLGGGLVPRGSHHHHHHSAWSHPQFEK

SEQ ID NO: 1059 - protein, 228 aa, Artificial sequence
  modified RSV protein
MELLILKANAITTILTAVTFCFASGNDLCNYIDKQLLPQVNKQSCSISNQETVQEFQQKNNRFLEITREASELYASLDAKLRCNVTNLPSDSSLSVTWTREKSGNLRPDPMTLQEHQNGTYSASSAVPVSTQDWLSGERFTCTVQHEELPNPLSKSVYRNTGPTTPPCLSNIKENKCNGTDAKVKLIKQEFDKYKNAVTELQLGGGLVPRGSHHHHHHSAWSHPQFEK

SEQ ID NO: 1060 - protein, 142 aa, Artificial sequence
  modified RSV protein
MELLILKANAITTILTAVTFCFASGQNDLKNYIDKQLLPQVNKQSCSISNQETVQEFQQKNNRFLEITREASDNDNEATAEGASNIKENKCNGTDAKVKLIKQELDKYKNAVTEAQLAGGLVPRGSHHHHHHSAWSHPQFEK

SEQ ID NO: 1061 - protein, 142 aa, Artificial sequence
  modified RSV protein
MELLILKANAITTILTAVTFCFASGQNDLCNYIDKQLLPQVNKQSCSISNQETVQEFQQKNNRFLEITREASDNDNEATAECASNIKENKCNGTDAKVKLIKQELDKYKNAVTEAQLAGGLVPRGSHHHHHHSAWSHPQFEK

SEQ ID NO: 1062 - protein, 142 aa, Artificial sequence
  modified RSV protein
MELLILKANAITTILTAVTFCFASGQNDLCNYIDKQLLPQVNKQSCSISNQETVQEFQQKNNRFLEITREASDNDNEATAECASNIKENKCNGTDAKVKLIKQEFDKYKNAVTEAQLAGGLVPRGSHHHHHHSAWSHPQFEK

SEQ ID NO: 1063 - protein, 148 aa, Artificial sequence
  modified RSV protein
MELLILKANAITTILTAVTFCFASGQNDLKNYIDKQLLPQVNKQSCSISNQETVQEFQQKNNRFLEITREASVNPNSEDLQQRKSNHSLSNIKENKCNGTDAKVKLIKQELDKYKNAVTELQLAGGLVPRGSHHHHHHSAWSHPQFEK

SEQ ID NO: 1064 - protein, 148 aa, Artificial sequence
  modified RSV protein
MELLILKANAITTILTAVTFCFASGQNDLCNYIDKQLLPQVNKQSCSISNQETVQEFQQKNNRFLEITREASVNPNSEDLQQRKSNHCLSNIKENKCNGTDAKVKLIKQELDKYKNAVTELQLAGGLVPRGSHHHHHHSAWSHPQFEK

SEQ ID NO: 1065 - protein, 148 aa, Artificial sequence
  modified RSV protein
MELLILKANAITTILTAVTFCFASGQNDLCNYIDKQLLPQVNKQSCSISNQETVQEFQQKNNRFLEITREASVNPNSEDLQQRKSNHCLSNIKENKCNGTDAKVKLIKQEFDKYKNAVTELQLAGGLVPRGSHHHHHHSAWSHPQFEK

SEQ ID NO: 1066 - protein, 254 aa, Artificial sequence
  modified RSV protein
MELLILKANAITTILTAVTFCFASGQNDLSNYIDKQLLPQVNKQSCSISNQETVQEFQQKNNRFLEITREASVNSGPAVIITQHMPPGFTRSFAERANKLCGASVKEAEDGERVLPGHAYIAPGDKHMELARSGANYQIKIHDGPPVNRHRPSVDVLFHSVAKHAGRNAVGVIGTGMGNDGAAGMLAMSQAGAGEASNIKENKCNGTDAKVKLIKQELDKYKNAVTELQLGGLVPRGSHHHHHHSAWSHPQFEK

SEQ ID NO: 1067 - protein, 254 aa, Artificial sequence
  modified RSV protein
MELLILKANAITTILTAVTFCFASGQNDLCNYIDKQLLPQVNKQSCSISNQETVQEFQQKNNRFLEITREASVNSGPAVIITQHMPPGFTRSFAERANKLCGASVKEAEDGERVLPGHAYIAPGDKHMELARSGANYQIKIHDGPPVNRHRPSVDVLFHSVAKHAGRNAVGVIGTGMGNDGAAGMLAMSQAGAGCASNIKENKCNGTDAKVKLIKQELDKYKNAVTELQLGGLVPRGSHHHHHHSAWSHPQFEK

SEQ ID NO: 1068 - protein, 254 aa, Artificial sequence
  modified RSV protein
MELLILKANAITTILTAVTFCFASGQNDLCNYIDKQLLPQVNKQSCSISNQETVQEFQQKNNRFLEITREASVNSGPAVIITQHMPPGFTRSFAERANKLCGASVKEAEDGERVLPGHAYIAPGDKHMELARSGANYQIKIHDGPPVNRHRPSVDVLFHSVAKHAGRNAVGVIGTGMGNDGAAGMLAMSQAGAGCASNIKENKCNGTDAKVKLIKQEFDKYKNAVTELQLGGLVPRGSHHHHHHSAWSHPQFEK

SEQ ID NO: 1069 - protein, 200 aa, Artificial sequence
  modified RSV protein
MELLILKANAITTILTAVTFCFASGQNDLKNYIDKQLLPQVNKQSCSISNQETVQEFQQKNNRFLEITREFSVRQSKELQAELDKMQNNSAVIGVKTVQLDVGCTSKIEKHYAYDGNETEDDTATSASERARDCQKKLTELSNIKENKCNGTDAKVKLIKQELDKYKNAVTELQLLGGLVPRGSHHHHHHSAWSHPQFEK

SEQ ID NO: 1070 - protein, 200 aa, Artificial sequence
  modified RSV protein
MELLILKANAITTILTAVTFCFASGQNDLCNYIDKQLLPQVNKQSCSISNQETVQEFQQKNNRFLEITREFSVRQSKELQAELDKMQNNSAVIGVKTVQLDVGCTSKIEKHYAYDGNETEDDTATSASERARDCQKKLTCLSNIKENKCNGTDAKVKLIKQELDKYKNAVTELQLLGGLVPRGSHHHHHHSAWSHPQFEK

SEQ ID NO: 1071 - protein, 200 aa, Artificial sequence
  modified RSV protein
MELLILKANAITTILTAVTFCFASGQNDLCNYIDKQLLPQVNKQSCSISNQETVQEFQQKNNRFLEITREFSVRQSKELQAELDKMQNNSAVIGVKTVQLDVGCTSKIEKHYAYDGNETEDDTATSASERARDCQKKLTCLSNIKENKCNGTDAKVKLIKQEFDKYKNAVTELQLLGGLVPRGSHHHHHHSAWSHPQFEK

SEQ ID NO: 1072 - protein, 162 aa, Artificial sequence
  modified RSV protein
MDSKGSSQKGSRLLLLLVVSNLLLPQGVVGQDLDLKNFIDKQLLPIMNKQSCSISNIELVIEFQQMNNRLLEAPGGELSNIKENKCNGTDAKVQLIKQELDKYKNAVRMKQIEDKIEEILSKIYHIENEIARIKKLIGSGLVPRGSHHHHHHSAWSHPQFEK

SEQ ID NO: 1073 - protein, 162 aa, Artificial sequence
  modified RSV protein
MDSKGSSQKGSRLLLLLVVSNLLLPQGVVGQDLDLCNFIDKQLLPIMNKQSCSISNIELVIEFQQMNNRLLEAPGGCLSNIKENKCNGTDAKVQLIKQELDKYKNAVRMKQIEDKIEEILSKIYHIENEIARIKKLIGSGLVPRGSHHHHHHSAWSHPQFEK

SEQ ID NO: 1074 - protein, 162 aa, Artificial sequence
  modified RSV protein
MDSKGSSQKGSRLLLLLVVSNLLLPQGVVGQDLCLKNFIDKQLLPIMNKQSCSISNIELVIEFQQMNNRLLEAPGGCLSNIKENKCNGTDAKVQLIKQELDKYKNAVRMKQIEDKIEEILSKIYHIENEIARIKKLIGSGLVPRGSHHHHHHSAWSHPQFEK

SEQ ID NO: 1075 - protein, 162 aa, Artificial sequence
  modified RSV protein
MDSKGSSQKGSRLLLLLVVSNLLLPQGVVGQDLDLKNFIDKQLLPIMNKQSCSISNIELVIEFQCMNNRLLEAPGGELSNIKENKCNGTDAKVCLIKQELDKYKNAVRMKQIEDKIEEILSKIYHIENEIARIKKLIGSGLVPRGSHHHHHHSAWSHPQFEK

SEQ ID NO: 1076 - protein, 162 aa, Artificial sequence
  modified RSV protein
MDSKGSSQKGSRLLLLLVVSNLLLPQGVVGQDLDLCNFIDKQLLPIMNKQSCSISNIELVIEFQCMNNRLLEAPGGCLSNIKENKCNGTDAKVCLIKQELDKYKNAVRMKQIEDKIEEILSKIYHIENEIARIKKLIGSGLVPRGSHHHHHHSAWSHPQFEK

SEQ ID NO: 1077 - protein, 162 aa, Artificial sequence
  modified RSV protein
MDSKGSSQKGSRLLLLLVVSNLLLPQGVVGQDLCLKNFIDKQLLPIMNKQSCSISNIELVIEFQCMNNRLLEAPGGCLSNIKENKCNGTDAKVCLIKQELDKYKNAVRMKQIEDKIEEILSKIYHIENEIARIKKLIGSGLVPRGSHHHHHHSAWSHPQFEK

SEQ ID NO: 1078 - protein, 157 aa, Artificial sequence
  modified RSV protein
MDSKGSSQKGSRLLLLLVVSNLLLPQGVVGQDLDLKNFIDKQLLPIMNKQSCSISNIELVIEFQQMNNRGSGELSNIKENKCNGTDAKVQLIKQELDKYKNAVRMKQIEDKIEEILSKIYHIENEIARIKKLIGGLVPRGSHHHHHHSAWSHPQFEK

SEQ ID NO: 1079 - protein, 157 aa, Artificial sequence
  modified RSV protein
MDSKGSSQKGSRLLLLLVVSNLLLPQGVVGQDLDLCNFIDKQLLPIMNKQSCSISNIELVIEFQQMNNRGSGCLSNIKENKCNGTDAKVQLIKQELDKYKNAVRMKQIEDKIEEILSKIYHIENEIARIKKLIGGLVPRGSHHHHHHSAWSHPQFEK

SEQ ID NO: 1080 - protein, 157 aa, Artificial sequence
  modified RSV protein
MDSKGSSQKGSRLLLLLVVSNLLLPQGVVGQDLCLKNFIDKQLLPIMNKQSCSISNIELVIEFQQMNNRGSGCLSNIKENKCNGTDAKVQLIKQELDKYKNAVRMKQIEDKIEEILSKIYHIENEIARIKKLIGGLVPRGSHHHHHHSAWSHPQFEK

SEQ ID NO: 1081 - protein, 157 aa, Artificial sequence
  modified RSV protein
MDSKGSSQKGSRLLLLLVVSNLLLPQGVVGQDLDLKNFIDKQLLPIMNKQSCSISNIELVIEFQCMNNRGSGELSNIKENKCNGTDAKVCLIKQELDKYKNAVRMKQIEDKIEEILSKIYHIENEIARIKKLIGGLVPRGSHHHHHHSAWSHPQFEK

SEQ ID NO: 1082 - protein, 157 aa, Artificial sequence
  modified RSV protein
MDSKGSSQKGSRLLLLLVVSNLLLPQGVVGQDLDLCNFIDKQLLPIMNKQSCSISNIELVIEFQCMNNRGSGCLSNIKENKCNGTDAKVCLIKQELDKYKNAVRMKQIEDKIEEILSKIYHIENEIARIKKLIGGLVPRGSHHHHHHSAWSHPQFEK

SEQ ID NO: 1083 - protein, 157 aa, Artificial sequence
  modified RSV protein
MDSKGSSQKGSRLLLLLVVSNLLLPQGVVGQDLCLKNFIDKQLLPIMNKQSCSISNIELVIEFQCMNNRGSGCLSNIKENKCNGTDAKVCLIKQELDKYKNAVRMKQIEDKIEEILSKIYHIENEIARIKKLIGGLVPRGSHHHHHHSAWSHPQFEK

SEQ ID NO: 1084 - protein, 152 aa, Artificial sequence
  modified RSV protein
MDSKGSSQKGSRLLLLLVVSNLLLPQGVVGQDVLDLCNYIDKQLLPIVNKQSCSISNICTVIEFQQKNNRLLEICREFSVNAGGGSGSGGCLSNIKENKCNGTDCKVKLIKQELDKYKNCVTELQLLMGGLVPRGSHHHHHHSAWSHPQFEK

SEQ ID NO: 1085 - protein, 152 aa, Artificial sequence
  modified RSV protein
MDSKGSSQKGSRLLLLLVVSNLLLPQGVVGQDVLDLCNYIDKQLLPIVNKQSCSISNICTVIEFFFKNLRLLWICWEFSVNAGGGSGSGGCLSNIKENKCNGTDCKVKLIKQELDKYKNCVTELQLLMGGLVPRGSHHHHHHSAWSHPQFEK

SEQ ID NO: 1086 - protein, 152 aa, Artificial sequence
  modified RSV protein
MDSKGSSQKGSRLLLLLVVSNLLLPQGVVGQDVLDLCNYIDKQLLPILNKQSCSISNICTVIEFFFKNLRLLWICWEFSVNAGGGSGSGGCLSNIKENKCNGTDCKVKLIKQELDKYKNCVTELQLLMGGLVPRGSHHHHHHSAWSHPQFEK

SEQ ID NO: 1087 - protein, 152 aa, Artificial sequence
  modified RSV protein
MDSKGSSQKGSRLLLLLVVSNLLLPQGVVGQDVLDLCNYIDKQLLPIVNKQSCSISNICTVIEFFFKNLRLLWICWEFSVNAGGGSGSGGCLSNIKENKCNGTDCKVKLIKQEFDKYKNCVTELQLLMGGLVPRGSHHHHHHSAWSHPQFEK

SEQ ID NO: 1088 - protein, 152 aa, Artificial sequence
  modified RSV protein
MDSKGSSQKGSRLLLLLVVSNLLLPQGVVGQDKLDLCNYIDKQLLPILNKQSCSISNICTVIEFFFKNLRLLWICWESSVNAGGGSGSGGCLSNIKENKCNGTDCKVKLIKQELDKYKNCVTELQLRKGGLVPRGSHHHHHHSAWSHPQFEK

SEQ ID NO: 1089 - protein, 22 aa, artificial sequence
  modified RSV protein
IIFLNENNVPVQLTSISAPEHK

SEQ ID NO: 1090 - protein, 52 aa, Artificial sequence
  modified RSV protein
LTSISAPEHKFEGLTQIFQKAYEHEQHISESINNIVDHAIKSKDHATFNFLQ

SEQ ID NO: 1091 - protein, 50 aa, Artificial sequence
  modified RSV protein
IIFLNENNVPVQLTSISAPEHKFEGLTQIFQKAYEHEQHISESINNIVDH

SEQ ID NO: 1092 - protein, 45 aa, artificial sequence
  modified RSV protein
IIFLNGLTQIFQKAYEHEQHISESINNIVDHAIKSKDHATFNFLQ

SEQ ID NO: 1093 - protein, 53 aa, artificial sequence
  modified RSV protein
IIFLNENNVPVQLTSISAPEHKFEGLTQIFQSINNIVDHAIKSKDHATFNFLQ

SEQ ID NO: 1094 - protein, 22 aa, artificial sequence
  modified RSV protein
IIFLIVDHAIKSKDHATFNFLQ

SEQ ID NO: 1095 - protein, 18 aa, artificial sequence
  modified RSV protein
IIFLNENNVPVQLTSILQ

SEQ ID NO: 1096 - protein, 36 aa, artificial sequence
  modified RSV protein
IIFKAYEHEQHISESINNIVDHAIKSKDHATFNFLQ

SEQ ID NO: 1097 - protein, 28 aa, artificial sequence
  modified RSV protein
IQHISESINNIVDHAIKSKDHATFNFLQ

SEQ ID NO: 1098 - protein, 90 aa, artificial sequence
  modified RSV protein
IIFLNENNVPDHAIKSKDHATFNFLQIIFLNENNVPVQLTSISAPEHKFEGLTQIFQKAYEHEQHISESINNIVDHAIKSKDHATFNFLQ

SEQ ID NO: 1099 - protein, 152 aa, Artificial sequence
  modified RSV protein
MDSKGSSQKGSRLLLLLVVSNLLLPQGVVGQDKLDLCNYIDKQLLPIVNKQSCSISNICTVIEFFFKNLRLLWICWEFSVNAGGGSGSGGCLSNIKENKCNGTDCKVKLIKQEFDKYKNCVTELQLRKGGLVPRGSHHHHHHSAWSHPQFEK

SEQ ID NO: 1100 - protein, 152 aa, Artificial sequence
  modified RSV protein
MDSKGSSQKGSRLLLLLVVSNLLLPQGVVGQDNLSLCNYIDKQLLPIVNKQSCSISNICTVIEFFFKNLRLLWICWESSVNAGNGSGSGGCLSNIKENKCNGTDCKVKLIKQEFDKYKNCVTELQLLKGGLVPRGSHHHHHHSAWSHPQFEK

SEQ ID NO: 1101 - protein, 152 aa, Artificial sequence
  modified RSV protein
MDSKGSSQKGSRLLLLLVVSNLLLPQGVVGQDNLSLCNYIDKQLLPILNKQSCSISNICTVIEFFFKNLRLLWICWESSVNAGNGSGSGGCLSNIKENKCNGTDCKVKLIKQELDKYKNCVTELQLLKGGLVPRGSHHHHHHSAWSHPQFEK

SEQ ID NO: 1102 - protein, 211 aa, Artificial sequence
  modified RSV protein
MDSKGSSQKGSRLLLLLVVSNLLLPQGVVGQDTICLSNIKENKCNGTDCKVKLIKQELDKYKNCVTELQLLMGGSGSGSGVLDLCNYIDKQLLPIVNKQSCSISNICTVIEFQQKNNRLLEICREFSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1103 - protein, 211 aa, Artificial sequence
  modified RSV protein
MDSKGSSQKGSRLLLLLVVSNLLLPQGVVGQDTICLSNIKENKCNGTDCKVKLIKQEFDKYKNCVTELQLLMGGSGSGSGVLDLCNYIDKQLLPIVNKQSCSISNICTVIEFQQKNNRLLEICREFSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1104 - protein, 211 aa, Artificial sequence
  modified RSV protein
MDSKGSSQKGSRLLLLLVVSNLLLPQGVVGQDTICLSNIKENKCNGTDCKVKLIKQELDKYKNCVTELQLLMGGSGSGSGVLDLCNYIDKQLLPILNKQSCSISNICTLIEFQQKNNRLLEICREFSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1105 - protein, 211 aa, Artificial sequence
  modified RSV protein
MDSKGSSQKGSRLLLLLVVSNLLLPQGVVGQDTICLSNIKENKCNGTDCKVKLIKQELDKYKNCVTELQLLMGGSGSGSGVLDLCNYIDKQLLPILNKQSCSISNICTVIEFFFKNLRLLWICWEFSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1106 - protein, 211 aa, Artificial sequence
  modified RSV protein
MDSKGSSQKGSRLLLLLVVSNLLLPQGVVGQDTICLSNIKENKCNGTDCKVKLIKQELDKYKNCVTELQLLKNGSGSGSGNLSLCNYIDKQLLPILNKQSCSISNICTVIEFFFKNLRLLWICWERSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1107 - protein, 211 aa, Artificial sequence
  modified RSV protein
MDSKGSSQKGSRLLLLLVVSNLLLPQGVVGQDTICLSNIKENKCNGTDAKVKLIKQELDKYKNCVTELQLLKNGSGSGSGNLSLCNYIDKQLLPILNKQSCSISNIETVIEFFFKNLRLLWICWERSVNGGGSSGVRLWATRQAMLGQVHEVPEGWLIFVAEQEELYVRVQNGFRKVQLEARTPLPRGGLVPRGSHHHHHHSAWSHPQFEK

SEQ ID NO: 1108 - protein, 348 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGLEVLFQGPHHHHHHHH

SEQ ID NO: 1109 - protein, 292 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGLEVLFQGPHHHHHHHH

SEQ ID NO: 1110 - protein, 242 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGLEVLFQGPHHHHHHHH

SEQ ID NO: 1111 - protein, 350 aa, Artificial sequence
  modified RSV protein
MELLILKANAITTILTAVTFCFASGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGLEVLFQGPHHHHHHHH

SEQ ID NO: 1112 - protein, 300 aa, Artificial sequence
  modified RSV protein
MELLILKANAITTILTAVTFCFASGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGLEVLFQGPHHHHHHHH

SEQ ID NO: 1113 - protein, 244 aa, Artificial sequence
  modified RSV protein
MELLILKANAITTILTAVTFCFASGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGGGSGELSNIKENKCNGTDAKVKLIKQELDKYKNAVTELQLLMGLEVLFQGPHHHHHHHH

SEQ ID NO: 1114 - protein, 176 aa, Artificial sequence
  modified RSV protein
MELLILKANAITTILTAVTFCFASGHHHHHHHHGLEVLFQGPGYIPEAPRDGQAYVRKDGEWVLLSTFLGIETVIEFQQKNNRLLEITREFSVGGSGGGSGGGSGELSNIKENKCNGTDAKVKLIKQELDKYKNAVTELQLLMGGSGGGSGGGDLKNYIDKQLLPIVNKQSCSISN

SEQ ID NO: 1115 - protein, 168 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGYIPEAPRDGQAYVRKDGEWVLLSTFLGLEVLFQGPHHHHHHHH

SEQ ID NO: 1116 - protein, 460 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGLEVLFQGPHHHHHHHH

SEQ ID NO: 1117 - protein, 171 aa, Artificial sequence
  modified RSV protein
MRPTWAWWLFLVLLLALWAPARGMLLQLETVANKYKLDEQKILKVKADTGNCKNEKINSLEITIVGGTFKVLDLKNYIDKQLLPILNKQSCSISNIETVIEFQQKNNRLLEITREFSVNGGYIPEAPRDGQAYVRKDGEWVLLSTFLGGLVPRGSHHHHHHSAWSHPQFEK

SEQ ID NO: 1118 - protein, 170 aa, Artificial sequence
  modified RSV protein
MRPTWAWWLFLVLLLALWAPARGMLLQLETVANKYKLDEQKILKVKADTGNCKNEKINSLEITIVGTFKVLDLKNYIDKQLLPILNKQSCSISNIETVIEFQQKNNRLLEITREFSVNGGYIPEAPRDGQAYVRKDGEWVLLSTFLGGLVPRGSHHHHHHSAWSHPQFEK

SEQ ID NO: 1119 - protein, 176 aa, Artificial sequence
  modified RSV protein
MRPTWAWWLFLVLLLALWAPARGMLLQLETVANKYKLDEQKILKVKADTGNCKNEKINSLEITIVGGTFKVLDLKNYIDKQLLPILNKQSCSISNIETVIEFQQKNNRLLEITREFSVNGGMKQIEDKIEEIESKIKKIENEIARIKKLIGEGGLVPRGSHHHHHHSAWSHPQFEK

SEQ ID NO: 1120 - protein, 399 aa, Artificial sequence
  modified RSV protein
MRPTWAWWLFLVLLLALWAPARGTFKVLDLKNYIDKQLLPILNKQSGANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDGKADTGNCKNEKINSLEITIVGGLVPRGSHHHHHHSAWSHPQFEK

SEQ ID NO: 1121 - protein, 83 aa, Artificial sequence
  modified RSV protein
MPMGSLQPLATLYLLGMLVASVLASNIKENKCPHCDKKFNDKQNLKQHNKQHQADGGGGSGLVPRGSHHHHHHSAWSHPQFEK

SEQ ID NO: 1122 - protein, 88 aa, Artificial sequence
  modified RSV protein
MPMGSLQPLATLYLLGMLVASVLASNIKENKCPHCDKKFGGKNQIDKQNLKQHNKQHQADGGGGSGLVPRGSHHHHHHSAWSHPQFEK

SEQ ID NO: 1123 - protein, 87 aa, Artificial sequence
  modified RSV protein
MPMGSLQPLATLYLLGMLVASVLASNIKENKCPGNGTHCDKKFNDKQNLKQHNKQHQADGGGGSGLVPRGSHHHHHHSAWSHPQFEK

SEQ ID NO: 1124 - protein, 80 aa, Artificial sequence
  modified RSV protein
MPMGSLQPLATLYLLGMLVASVLAKEHKCPHCDKKFNQVGNLKQHLPIHNKQSGGGSGLVPRGSHHHHHHSAWSHPQFEK

SEQ ID NO: 1125 - protein, 80 aa, Artificial sequence
  modified RSV protein
MPMGSLQPLATLYLLGMLVASVLAKEHKCPHCDKKFNQVGNEKQHLPIHNKQSGGGSGLVPRGSHHHHHHSAWSHPQFEK

SEQ ID NO: 1126 - protein, 80 aa, Artificial sequence
  modified RSV protein
MPMGSLQPLATLYLLGMLVASVLAKEHKCPHCDKKFNQVGNKKQHLPIHNKQSGGGSGLVPRGSHHHHHHSAWSHPQFEK

SEQ ID NO: 1127 - protein, 261 aa, Artificial sequence
  modified RSV protein
MPMGSLQPLATLYLLGMLVASVLASGWYTSVITIELSNIKNKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGSLEVLFQGPGHHHHHH

SEQ ID NO: 1128 - protein, 261 aa, Artificial sequence
  modified RSV protein
MPMGSLQPLATLYLLGMLVASVLASGWYTSVITIELSNIKNKCNGTDAKVKQIKQELDKYKNAVTELQQLMQSTPCTNGTAGSAIASGVAVCKVLHLEGEVNKTKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGSLEVLFQGPGHHHHHH

SEQ ID NO: 1129 - protein, 259 aa, Artificial sequence
  modified RSV protein
MPMGSLQPLATLYLLGMLVASVLASGWYTSVITIELSNIKNKCNGTDAKVKQIKQELDKYKNAVTELQQLMQSTPCTNGTAGSAIASGVAVCKVLHLEGEVNKTKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKNMSNNVQIVRQQSYSIMCIIKEEVLAYVVQLSSGSLEVLFQGPGHHHHHH

SEQ ID NO: 1130 - protein, 261 aa, Artificial sequence; identical to SEQ ID NO: 1127
  modified RSV protein

SEQ ID NO: 1131 - protein, 261 aa, Artificial sequence; identical to SEQ ID NO: 1128
  modified RSV protein

SEQ ID NO: 1132 - protein, 259 aa, Artificial sequence
  modified RSV protein
MPMGSLQPLATLYLLGMLVASVLASGWYTSVITIELSNIKNKCNGTDAKVKQIKQELDKYKNAVTELQQLMQSTPQTNGTAGSAIASGVAVCKVLHLEGEVNKTKSSLLSTNKSQVSLSNGVSVLTFKVLDLKNYIDKQLLPILNKQSCSISNQETVQEFQQKNNRLLEITREFSQNAGVTTPVSTYMLTNSELLSLINDMPITNDQKKNMSNNVQIVRQQSYSIMCIIKEEVLAYVVQLSSGSLEVLFQGPGHHHHHH

SEQ ID NO: 1133 - protein, 262 aa, Artificial sequence
  modified RSV protein
MPMGSLQPLATLYLLGMLVASVLASSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKNKCNGTDAKVKQIKQELDKYKNAVTELQQLMQSTPCTNGGAGGSLEVLFQGPGHHHHHH

SEQ ID NO: 1134 - protein, 262 aa, Artificial sequence
  modified RSV protein
MPMGSLQPLATLYLLGMLVASVLASSAIASGVAVCKVLHLEGEVNKTKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKNKCNGTDAKVKQIKQELDKYKNAVTELQQLMQSTPCTNGTAGGSLEVLFQGPGHHHHHH

SEQ ID NO: 1135 - protein, 260 aa, Artificial sequence
  modified RSV protein
MPMGSLQPLATLYLLGMLVASVLASSAIASGVAVCKVLHLEGEVNKTKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKNMSNNVQIVRQQSYSIMCIIKEEVLAYVVQLSSGGWYTSVITIELSNIKNKCNGTDAKVKQIKQELDKYKNAVTELQQLMQSTPCTNGTAGGSLEVLFQGPGHHHHHH

SEQ ID NO: 1136 - protein, 262 aa, Artificial sequence
  modified RSV protein
MPMGSLQPLATLYLLGMLVASVLASSAIASGVAVCKVLHLEGEVNKIKSSLLSTNKSQVSLSNGVSVLTFKVLDLKNYIDKQLLPILNKQSCSISNQETVQEFQQKNNRLLEITREFSQNAGVTTPVSTYMLTNSELLSLINDMPITNDQKKLMSNNVQIVRQQSYSIMCIIKEEVLAYVVQLPLYGGGWYTSVITIELSNIKNKCNGTDAKVKQIKQELDKYKNAVTELQQLMQSTPQTNGGAGGSLEVLFQGPGHHHHHH

SEQ ID NO: 1137 - protein, 262 aa, Artificial sequence
  modified RSV protein
MPMGSLQPLATLYLLGMLVASVLASSAIASGVAVCKVLHLEGEVNKTKSSLLSTNKSQVSLSNGVSVLTFKVLDLKNYIDKQLLPILNKQSCSISNQETVQEFQQKNNRLLEITREFSQNAGVTTPVSTYMLTNSELLSLINDMPITNDQKKLMSNNVQIVRQQSYSIMCIIKEEVLAYVVQLPLYGGGWYTSVITIELSNIKNKCNGTDAKVKQIKQELDKYKNAVTELQQLMQSTPQTNGTAGGSLEVLFQGPGHHHHHH

SEQ ID NO: 1138 - protein, 260 aa, Artificial sequence
  modified RSV protein
MPMGSLQPLATLYLLGMLVASVLASSAIASGVAVCKVLHLEGEVNKTKSSLLSTNKSQVSLSNGVSVLTFKVLDLKNYIDKQLLPILNKQSCSISNQETVQEFQQKNNRLLEITREFSQNAGVTTPVSTYMLTNSELLSLINDMPITNDQKKNMSNNVQIVRQQSYSIMCIIKEEVLAYVVQLSSGGWYTSVITIELSNIKNKCNGTDAKVKQIKQELDKYKNAVTELQQLMQSTPQTNGTAGGSLEVLFQGPGHHHHHH

SEQ ID NO: 1139 - protein, 267 aa, Artificial sequence
  modified RSV protein
MDSKGSSQKGSRLLLLLVVSNLLLPQGVVGQTGWYTSVITIELSNIKENKCNGTDAKVKLIKQELDKYKNAVTELQLLGSGGGSGASGVAVCKVLHLEGEVNKIKSALLSTNKAVVSLSNGVSVLTFKVLDLKNFIDKQLLPIMNKQSCSISNIELVIEFQQMNNRLLEITREFSVNAGVTTPVSTYMLTNSELLSLINDMPITNDQKKLMSNNVQIVRQQSYSIMCIIKEEVLAYVVQLPLYGGLVPRGSHHHHHHSAWSHPQFEK

SEQ ID NO: 1140 - protein, 267 aa, Artificial sequence
  modified RSV protein
MDSKGSSQKGSRLLLLLVVSNLLLPQGVVGQTGWYTSVITICLSNIKENKCNGTDAKVKLIKQELDKYKNAVTELQLLGSGGGSGASGVAVCKVLHLEGEVNKIKSALLSTNKAVVSLSNGVSVLTFKVLDLCNFIDKQLLPIMNKQSCSISNIELVIEFQQMNNRLLEITREFSVNAGVTTPVSTYMLTNSELLSLINDMPITNDQKKLMSNNVQIVRQQSYSIMCIIKEEVLAYVVQLPLYGGLVPRGSHHHHHHSAWSHPQFEK

SEQ ID NO: 1141 - protein, 272 aa, Artificial sequence
  modified RSV protein
MPMGSLQPLATLYLLGMLVASVLAQQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1142 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1143 - protein, 272 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1144 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1145 - protein, 275 aa, Artificial sequence
  modified RSV protein
MPMGSLQPLATLYLLGMLVASVLAQQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGLVPRGSHHHHHHSAWSHPQFEK

SEQ ID NO: 1146 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNQETVQEFQQKNNRLLEITREFSSNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNGGLVPRGSHHHHHHSAWSHPQFEK

SEQ ID NO: 1147 - protein, 272 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNQETVQEFQQKNNRLLEITREFSSNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNGGLVPRGSHHHHHHSAWSHPQFEK

SEQ ID NO: 1148 - protein, 272 aa, Artificial sequence
  modified RSV protein
MPMGSLQPLATLYLLGMLVASVLAQQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1149 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1150 - protein, 272 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1151 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGLVPRGSHHHHHHSAWSHPQFEK

SEQ ID NO: 1152 - protein, 275 aa, Artificial sequence
  modified RSV protein
MPMGSLQPLATLYLLGMLVASVLAQQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGLVPRGSHHHHHHSAWSHPQFEK

SEQ ID NO: 1153 - protein, 272 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNQETVQEFQQKNNRLLEITREFSSNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNGGLVPRGSHHHHHHSAWSHPQFEK

SEQ ID NO: 1154 - protein, 272 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNGGLVPRGSHHHHHHSAWSHPQFEK

SEQ ID NO: 1155 - protein, 272 aa, Artificial sequence
  modified RSV protein
MPMGSLQPLATLYLLGMLVASVLAQQSAIASGTAVCKVLHKEGEVNKIKSSLLSTNKSQVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQQLMQSTPATNNGGLVPRGSHHHHHHSAWSHPQFEK

SEQ ID NO: 1156 - protein, 271 aa, Artificial sequence
  modified RSV protein
MPMGSLQPLATLYLLGMLVASVLAQQSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGWYTSVITIELSNIKENKCNGTDAKVKQIKQELDKYKNAVTELQQLMQSTPCTNGGAGGGLVPRGSHHHHHHSAWSHPQFEK

SEQ ID NO: 1157 - protein, 268 aa, Artificial sequence
  modified RSV protein
MPMGSLQPLATLYLLGMLVASVLAGWYTSVITIELSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGLVPRGSHHHHHHSAWSHPQFEK

SEQ ID NO: 1158 - protein, 272 aa, Artificial sequence
  modified RSV protein
MPMGSLQPLATLYLLGMLVASVLAQQSAIASGTAVCKVLHKEGEVNKIKSSLLSTNKSQVSLSNGTSVLTFKVLDLCNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITICLSNIKENKCNGTDAKVKKIKQELDKYKNAVTELQQLMQSTPATNNGGLVPRGSHHHHHHSAWSHPQFEK

SEQ ID NO: 1159 - protein, 271 aa, Artificial sequence
  modified RSV protein
MPMGSLQPLATLYLLGMLVASVLAQQSAIASGVAVCKVLHLEGEVNKIKSSLLSTNKSQVSLSNGVSVLTFKVLDLCNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGWYTSVITICLSNIKENKCNGTDAKVKQIKQELDKYKNAVTELQQLMQSTPCTNGGAGGGLVPRGSHHHHHHSAWSHPQFEK

SEQ ID NO: 1160 - protein, 268 aa, Artificial sequence
  modified RSV protein
MPMGSLQPLATLYLLGMLVASVLAGWYTSVITICLSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLCNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGLVPRGSHHHHHHSAWSHPQFEK

SEQ ID NO: 1161 - protein, 271 aa, Artificial sequence
  modified RSV protein
MPMGSLQPLATLYLLGMLVASVLAQQSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKENKCNGTDAKVKQIKQELDKYKNAVTELQQLMQSTPCTNGGAGGGLVPRGSHHHHHHSAWSHPQFEK

SEQ ID NO: 1162 - protein, 268 aa, Artificial sequence
  modified RSV protein
MPMGSLQPLATLYLLGMLVASVLAGWYTSVITIELSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGLVPRGSHHHHHHSAWSHPQFEK

SEQ ID NO: 1163 - protein, 271 aa, Artificial sequence
  modified RSV protein
MPMGSLQPLATLYLLGMLVASVLAQQSAIASGVAVCKVLHLEGEVNKIKSSLLSTNKSQVSLSNGVSVLTFKVLDLCNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITICLSNIKENKCNGTDAKVKQIKQELDKYKNAVTELQQLMQSTPCTNGGAGGGLVPRGSHHHHHHSAWSHPQFEK

SEQ ID NO: 1164 - protein, 268 aa, Artificial sequence
  modified RSV protein
MPMGSLQPLATLYLLGMLVASVLAGWYTSVITICLSNIKNEKCNGTDAKVKQIKQELDKYKNAVTELQQLMQSTPCTNGGAGSAIASGVAVCKVLHLEGEVNKIKSSLLSTNKSQVSLSNGVSVLTFKVLDLCNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGLVPRGSHHHHHHSAWSHPQFEK

SEQ ID NO: 1165 - protein, 319 aa, Artificial sequence
  modified RSV protein
MPMGSLQPLATLYLLGMLVASVLAAESALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGLVPRGSHHHHHHSAWSHPQFEK

SEQ ID NO: 1166 - protein, 322 aa, Artificial sequence
  modified RSV protein
MPMGSLQPLATLYLLGMLVASVLAAESALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGLVPRGSHHHHHHSAWSHPQFEK

SEQ ID NO: 1167 - protein, 309 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSHHHHHHSAWSHPQFEK

SEQ ID NO: 1168 - protein, 312 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSHHHHHHSAWSHPQFEK

SEQ ID NO: 1169 - protein, 306 aa, Artificial sequence
  modified RSV protein
MPMGSLQPLATLYLLGMLVASVLAQQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1170 - protein, 306 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1171 - protein, 306 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1172 - protein, 306 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1173 - protein, 309 aa, Artificial sequence
  modified RSV protein
MPMGSLQPLATLYLLGMLVASVLAQQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGGLVPRGSHHHHHHSAWSHPQFEK

SEQ ID NO: 1174 - protein, 306 aa, Artificial sequence
  modified RSV protein
MPMGSLQPLATLYLLGMLVASVLAQQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1175 - protein, 306 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1176 - protein, 306 aa, Artificial sequence
  modified RSV protein
MPMGSLQPLATLYLLGMLVASVLAQQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1177 - protein, 306 aa, Artificial sequence
  modified RSV protein
MPMGSLQPLATLYLLGMLVASVLAQQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGLVPRGSHHHHHHSAWSHPQFEK

SEQ ID NO: 1178 - protein, 309 aa, Artificial sequence
  modified RSV protein
MPMGSLQPLATLYLLGMLVASVLAQQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGGLVPRGSHHHHHHSAWSHPQFEK

SEQ ID NO: 1179 - protein, 343 aa, Artificial sequence
  modified RSV protein
MPMGSLQPLATLYLLGMLVASVLAAEHHHHHHHHSAWSHPQFEKGGLVPRGSGGSYIPEAPRDGQAYVRKDGEWVLLSTFLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPAT

SEQ ID NO: 1180 - protein, 342 aa, Artificial sequence
  modified RSV protein
MPMGSLQPLATLYLLGMLVASVLAAEAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGYIPEAPRDGQAYVRKDGEWVLLSTFLGGLVPRGSGSHHHHHHHHSAWSHPQFEK

SEQ ID NO: 1181 - protein, 322 aa, Artificial sequence
  modified RSV protein
MYSMQLASCVTLTLVLLVNSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGSHMEEDPCECKSIVKFQTKVEELINTLQQKLEAVAKRIEALENKIIGSLVPRGSHHHHHHHHSAWSHPQFEK

SEQ ID NO: 1182 - protein, 326 aa, Artificial sequence
  modified RSV protein
MYSMQLASCVTLTLVLLVNSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGGGSGSHMEEDPCECKSIVKFQTKVEELINTLQQKLEAVAKRIEALENKIIGSLVPRGSHHHHHHHHSAWSHPQFEK

SEQ ID NO: 1183 - protein, 329 aa, Artificial sequence
  modified RSV protein
MYSMQLASCVTLTLVLLVNSQGSHMEEDPCECKSIVKFQTKVEELINTLQQKLEAVAKRIEALENKIIGGGSGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1184 - protein, 331 aa, Artificial sequence
  modified RSV protein
MYSMQLASCVTLTLVLLVNSQGSHMEEDPCECKSIVKFQTKVEELINTLQQKLEAVAKRIEALENKIIGGGSFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1185 - protein, 318 aa, Artificial sequence
  modified RSV protein
MYSMQLASCVTLTLVLLVNSQGSHMEEDPCECKSIVKFQTKVEELINTLQQKLEAVAKRIEALENKIISAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1186 - protein, 318 aa, Artificial sequence
  modified RSV protein
MYSMQLASCVTLTLVLLVNSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGGSGGIKEEIAKIKEEQAKIKEKIAEIEKRIAEIEKRIAGGCCGSLVPRGSHHHHHHHHSAWSHPQFEK

SEQ ID NO: 1187 - protein, 322 aa, Artificial sequence
  modified RSV protein
MYSMQLASCVTLTLVLLVNSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGGGSGGSGGIKEEIAKIKEEQAKIKEKIAEIEKRIAEIEKRIAGGCCGSLVPRGSHHHHHHHHSAWSHPQFEK

SEQ ID NO: 1188 - protein, 314 aa, Artificial sequence
  modified RSV protein
MYSMQLASCVTLTLVLLVNSQGGSGGIKEEIAKIKEEQAKIKEKIAEIEKRIAEIEKRIAGGCCSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1189 - protein, 321 aa, Artificial sequence
  modified RSV protein
MYSMQLASCVTLTLVLLVNSQGGSGGIKEEIAKIKEEQAKIKEKIAEIEKRIAEIEKRIAGGCCGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1190 - protein, 323 aa, Artificial sequence
  modified RSV protein
MYSMQLASCVTLTLVLLVNSQGGSGGIKEEIAKIKEEQAKIKEKIAEIEKRIAEIEKRIAGGCCFLGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSLVPRGSHHHHHHHHSAWSHPQFEK

SEQ ID NO: 1191 - protein, 587 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1192 - protein, 593 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1193 - protein, 575 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1194 - protein, 581 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1195 - protein, 592 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGSGGGGALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1196 - protein, 598 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGSGGGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1197 - protein, 580 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1198 - protein, 586 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1199 - protein, 506 aa, Artificial sequence
  modified RSV protein
MELLILKANAITTILTAVTFCFASGQNITGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGGSGGGSGGGSGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGLVPRGSHHHHHHSAWSHPQFEK

SEQ ID NO: 1200 - protein, 506 aa, Artificial sequence
  modified RSV protein
MELLILKANAITTILTAVTFCFASGQNITGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGGSGGGSGGGSGGGFLGFLLGVGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGLVPRGSHHHHHHSAWSHPQFEK

SEQ ID NO: 1201 - protein, 502 aa, Artificial sequence
  modified RSV protein
MELLILKANAITTILTAVTFCFASGQNITGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGLVPRGSHHHHHHSAWSHPQFEK

SEQ ID NO: 1202 - protein, 502 aa, Artificial sequence
  modified RSV protein
MELLILKANAITTILTAVTFCFASGQNITGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGLVPRGSHHHHHHSAWSHPQFEK

SEQ ID NO: 1203 - protein, 497 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGLVPRGSHHHHHHSAWSHPQFEK

SEQ ID NO: 1204 - protein, 497 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGLVPRGSHHHHHHSAWSHPQFEK

SEQ ID NO: 1205 - protein, 501 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGGSGGGSGGGSGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMGGLVPRGSHHHHHHSAWSHPQFEK

SEQ ID NO: 1206 - protein, 501 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGGSGGGSGGGSGGGFLGFLLGVGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDCKVKLIKQELDKYKNAVTELQLLMGGLVPRGSHHHHHHSAWSHPQFEK

SEQ ID NO: 1207 - protein, 497 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGRGGTGWYTSVITIELSNIKENKCNGTDAKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGRGGTGWYTSVITIELSNIKENKCNGTDAKVKLIKQELDKYKNAVTELQLLMGGLVPRGSHHHHHHSAWSHPQFEK

SEQ ID NO: 1208 - protein, 497 aa, Artificial sequence
  modified RSV protein
MELGLSLVVLAALLQGVQAAVQLQGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGRGGTGWYTSVITIELSNIKENKCNGTDCKVKLIKQELDKYKNAVTELQLLMGGGSGGGSGGGFLGFLLGVGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGGRGGTGWYTSVITIELSNIKENKCNGTDCKVKLIKQELDKYKNAVTELQLLMGGLVPRGSHHHHHHSAWSHPQFEK

SEQ ID NO: 1209 - protein, 614 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGYIPEAPRDGQAYVRKDGEWVLLSTFLGGALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1210 - protein, 620 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGYIPEAPRDGQAYVRKDGEWVLLSTFLGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1211 - protein, 602 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGYIPEAPRDGQAYVRKDGEWVLLSTFLGGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1212 - protein, 608 aa, Artificial sequence
  modified RSV protein
MPMGSLQPLATLYLLGMLVASVLAAEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGYIPEAPRDGQAYVRKDGEWVLLSTFLGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGLVPRGSGSHHHHHHHHSAWSHPQFEK

SEQ ID NO: 1213 - protein, 604 aa, Artificial sequence
  modified RSV protein
MPMGSLQPLATLYLLGMLVASVLAAEAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGYIPEAPRDGQAYVRKDGEWVLLSTFLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGLVPRGSGSHHHHHHHHSAWSHPQFEK

SEQ ID NO: 1214 - protein, 605 aa, Artificial sequence
  modified RSV protein
MPMGSLQPLATLYLLGMLVASVLAAEHHHHHHHHSAWSHPQFEKGGLVPRGSGGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGYIPEAPRDGQAYVRKDGEWVLLSTFLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPAT

SEQ ID NO: 1215 - protein, 625 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGGGGGGGGGYIPEAPRDGQAYVRKDGEWVLLSTFLGGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGGSGALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1216 - protein, 628 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGGGGGGGGGYIPEAPRDGQAYVRKDGEWVLLSTFLGGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGGSGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1217 - protein, 625 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGYIPEAPRDGQAYVRKDGEWVLLSTFLGGGGGGGGGGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGGSGALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1218 - protein, 628 aa, Artificial sequence
  modified RSV protein
MPMGSLQPLATLYLLGMLVASVLAAEALRTGWYTSVITIELSNIKENKCNGTDAKVKLIKQELDKYKNAVTELQLLMQSTPATGGYIPEAPRDGQAYVRKDGEWVLLSTFLGGGGGGGGGGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGGSGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGLVPRGSGSHHHHHHHHSAWSHPQFEK

SEQ ID NO: 1219 - protein, 497 aa, Artificial sequence
  modified RSV protein
MPMGSLQPLATLYLLGMLVASVLAAEHHHHHHHHSAWSHPQFEKGGLVPRGSGGSSALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1220 - protein, 500 aa, Artificial sequence
  modified RSV protein
MPMGSLQPLATLYLLGMLVASVLAAEHHHHHHHHSAWSHPQFEKGGLVPRGSGGSSALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1221 - protein, 487 aa, Artificial sequence
  modified RSV protein
MPMGSLQPLATLYLLGMLVASVLAAEHHHHHHHHSAWSHPQFEKGGLVPRGSGGSGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1222 - protein, 490 aa, Artificial sequence
  modified RSV protein
MPMGSLQPLATLYLLGMLVASVLAAEHHHHHHHHSAWSHPQFEKGGLVPRGSGGSGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1223 - protein, 296 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDCKVKLIKQELDKYKNAVTELQLLMGSGGSGSGDLKNYIDKQLLPIVNKQSCSISNICTVIEFQQKNNRLLEITREFSVN

SEQ ID NO: 1224 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDCKVKLIKQELDKYKNAVTELQLLMGSGGSGSGGDLKNYIDKQLLPIVNKQSCSISNICTVIEFQQKNNRLLEITREFSVN

SEQ ID NO: 1225 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDCKVKLIKQELDKYKNAVTELQLLMGSGGSGSGDLKNYIDKQLLPIVNKQSCSISNICTVIEFQQKNNRLLEITREFSVN

SEQ ID NO: 1226 - protein, 298 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDCKVKLIKQELDKYKNAVTELQLLMGSGGSGSGGDLKNYIDKQLLPIVNKQSCSISNICTVIEFQQKNNRLLEITREFSVN

SEQ ID NO: 1227 - protein, 296 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDAKIKLIKQELDKYKNAVTELQLLMGSGGSGSGDMKNYIDKQLLPIVNKQSCSISNIETVIEFQQKNNRLLEITREFSVN

SEQ ID NO: 1228 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDAKIKLIKQELDKYKNAVTELQLLMGSGGSGSGGDMKNYIDKQLLPIVNKQSCSISNIETVIEFQQKNNRLLEITREFSVN

SEQ ID NO: 1229 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDAKIKLIKQELDKYKNAVTELQLLMGSGGSGSGDMKNYIDKQLLPIVNKQSCSISNIETVIEFQQKNNRLLEITREFSVN

SEQ ID NO: 1230 - protein, 298 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDAKIKLIKQELDKYKNAVTELQLLMGSGGSGSGGDMKNYIDKQLLPIVNKQSCSISNIETVIEFQQKNNRLLEITREFSVN

SEQ ID NO: 1231 - protein, 296 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDCKIKLIKQELDKYKNAVTELQLLMGSGGSGSGDMKNYIDKQLLPIVNKQSCSISNICTVIEFQQKNNRLLEITREFSVN

SEQ ID NO: 1232 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGSGSLEIELSNIKENKCNGTDCKIKLIKQELDKYKNAVTELQLLMGSGGSGSGGDMKNYIDKQLLPIVNKQSCSISNICTVIEFQQKNNRLLEITREFSVN

SEQ ID NO: 1233 - protein, 297 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDCKIKLIKQELDKYKNAVTELQLLMGSGGSGSGDMKNYIDKQLLPIVNKQSCSISNICTVIEFQQKNNRLLEITREFSVN

SEQ ID NO: 1234 - protein, 298 aa, Artificial sequence
  modified RSV protein
MDSKGSSQKGSRLLLLLVVSNLLLPQGVVGQGGHHHHHHGGLVPRGSADPEVAAAAAQFLTPVVHKMQALVVNGKQAHWNVRGSNFIAIHELLDSVVAHAQDYADTAAERIVALGLPIDSRVSTMAEKTSTAVPAGFAQWQDEIKAIVSDIDAALVDLQAAIDGLDEVDLTSQDVAIEIKRGVDKDRWFLLAHLAEGGSGSLEIELSNIKENKCNGTDCKIKLIKQELDKYKNAVTELQLLMGSGGSGSGGDMKNYIDKQLLPIVNKQSCSISNICTVIEFQQKNNRLLEITREFSVN

SEQ ID NO: 1235 - protein, 427 aa, Artificial sequence
  modified RSV protein
MDSKGSSQKGSRLLLLLVVSNLLLPQGVVGQGGHHHHHHGGLVPRGSGYTSVITIELSNIKENKCNGTDAKVKLIKQELDKYKNAVTELQLLMGSGGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1236 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDAKVKLIKQELDKYKNAVTELQLLMGSGSGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1237 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDAKVKLIKQELDKYKNAVTELQLLMGSGGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1238 - protein, 429 aa, Artificial sequence
  modified RSV protein
MDSKGSSQKGSRLLLLLVVSNLLLPQGVVGQGGHHHHHHGGLVPRGSGYTSVITIELSNIKENKCNGTDAKVKLIKQELDKYKNAVTELQLLMGSGSGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1239 - protein, 427 aa, Artificial sequence
  modified RSV protein
MDSKGSSQKGSRLLLLLVVSNLLLPQGVVGQGGHHHHHHGGLVPRGSGYTSVITIELSNIKENKCNGTDAKIKLIKQELDKYKNAVTELQLLMGSGGGSGIASGVAVCKVLHLEGEVNKIKSALLSTNKAVVSLSNGVSVLTFKVLDMKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1240 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDAKIKLIKQELDKYKNAVTELQLLMGSGSGGSGIASGVAVCKVLHLEGEVNKIKSALLSTNKAVVSLSNGVSVLTFKVLDMKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1241 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDAKIKLIKQELDKYKNAVTELQLLMGSGGGSGIASGVAVCKVLHLEGEVNKIKSALLSTNKAVVSLSNGVSVLTFKVLDMKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1242 - protein, 429 aa, Artificial sequence
  modified RSV protein
MDSKGSSQKGSRLLLLLVVSNLLLPQGVVGQGGHHHHHHGGLVPRGSGYTSVITIELSNIKENKCNGTDAKIKLIKQELDKYKNAVTELQLLMGSGSGGSGIASGVAVCKVLHLEGEVNKIKSALLSTNKAVVSLSNGVSVLTFKVLDMKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1243 - protein, 427 aa, Artificial sequence
  modified RSV protein
MDSKGSSQKGSRLLLLLVVSNLLLPQGVVGQGGHHHHHHGGLVPRGSGYTSVITIELSNIKENKCNGTDCKVKLIKQELDKYKNAVTELQLLMGSGGGSGIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1244 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDCKVKLIKQELDKYKNAVTELQLLMGSGSGGSGIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1245 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDCKVKLIKQELDKYKNAVTELQLLMGSGGGSGIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1246 - protein, 429 aa, Artificial sequence
  modified RSV protein
MDSKGSSQKGSRLLLLLVVSNLLLPQGVVGQGGHHHHHHGGLVPRGSGYTSVITIELSNIKENKCNGTDCKVKLIKQELDKYKNAVTELQLLMGSGSGGSGIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1247 - protein, 427 aa, Artificial sequence
  modified RSV protein
MDSKGSSQKGSRLLLLLVVSNLLLPQGVVGQGGHHHHHHGGLVPRGSGYTSVITIELSNIKENKCNGTDCKIKLIKQELDKYKNAVTELQLLMGSGGGSGIASGVAVCKVLHLEGEVNKIKSALLSTNKAVVSLSNGVSVLTFKVLDMKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1248 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDCKIKLIKQELDKYKNAVTELQLLMGSGSGGSGIASGVAVCKVLHLEGEVNKIKSALLSTNKAVVSLSNGVSVLTFKVLDMKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1249 - protein, 428 aa, Artificial sequence
  modified RSV protein
MDSKGSSQKGSRLLLLLVVSNLLLPQGVVGQGGHHHHHHGGLVPRGSGYTSVITIELSNIKENKCNGTDCKIKLIKQELDKYKNAVTELQLLMGSGGGSGIASGVAVCKVLHLEGEVNKIKSALLSTNKAVVSLSNGVSVLTFKVLDMKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1250 - protein, 429 aa, Artificial sequence
  modified RSV protein
MDSKGSSQKGSRLLLLLVVSNLLLPQGVVGQGGHHHHHHGGLVPRGSGYTSVITIELSNIKENKCNGTDCKIKLIKQELDKYKNAVTELQLLMGSGSGGSGIASGVAVCKVLHLEGEVNKIKSALLSTNKAVVSLSNGVSVLTFKVLDMKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1251 - protein, 435 aa, Artificial sequence
  modified RSV protein
MDSKGSSQKGSRLLLLLVVSNLLLPQGVVGQGGHHHHHHGGLVPRGSGYTSVITIELSNIKNKCNGTDAKVKQIKQELDKYKNAVTELQQLMQSTPCTNGGAGSGIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGSGSGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1252 - protein, 434 aa, Artificial sequence
  modified RSV protein
MDSKGSSQKGSRLLLLLVVSNLLLPQGVVGQGGHHHHHHGGLVPRGSGYTSVITIELSNIKNKCNGTDAKVKQIKQELDKYKNAVTELQQLMQSTPCTNGGAGSGIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGSGGSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1253 - protein, 443 aa, Artificial sequence
  modified RSV protein
MPMGSLQPLATLYLLGMLVASVLAQQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1254 - protein, 443 aa, Artificial sequence
  modified RSV protein
MPMGSLQPLATLYLLGMLVASVLAQQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1255 - protein, 445 aa, Artificial sequence
  modified RSV protein
MPMGSLQPLATLYLLGMLVASVLAQQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1256 - protein, 445 aa, Artificial sequence
  modified RSV protein
MPMGSLQPLATLYLLGMLVASVLAQQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1257 - protein, 445 aa, Artificial sequence
  modified RSV protein
MPMGSLQPLATLYLLGMLVASVLAQQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1258 - protein, 443 aa, Artificial sequence
  modified RSV protein
MPMGSLQPLATLYLLGMLVASVLAQQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1259 - protein, 445 aa, Artificial sequence
  modified RSV protein
MPMGSLQPLATLYLLGMLVASVLAQQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1260 - protein, 470 aa, Artificial sequence
  modified RSV protein
MRPTWAWWLFLVLLLALWAPARGSAWSHPQFEKHHHHHHHHLVPRGSTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1261 - protein, 474 aa, Artificial sequence
  modified RSV protein
MRPTWAWWLFLVLLLALWAPARGSAWSHPQFEKHHHHHHHHLVPRGSGGTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1262 - protein, 435 aa, Artificial sequence
  modified RSV protein
MRPTWAWWLFLVLLLALWAPARGSAWSHPQFEKHHHHHHHHLVPRGSGWYTSVITIELSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1263 - protein, 429 aa, Artificial sequence
  modified RSV protein
MRPTWAWWLFLVLLLALWAPARGSAWSHPQFEKHHHHHHHHLVPRGSSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKENKCNGTDAKVKQIKQELDKYKNAVTELQQLMQSTPCTNGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1264 - protein, 567 aa, Artificial sequence
  modified RSV protein
MRPTWAWWLFLVLLLALWAPARGSAWSHPQFEKHHHHHHHHLVPRGSTFKVLDLKNYIDKQLLPILNKQSGANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDGKADTGNCKNEKINSLEITIVGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1265 - protein, 533 aa, Artificial sequence
  modified RSV protein
MPMGSLQPLATLYLLGMLVASVLAAEHHHHHHHHSAWSHPQFEKGGLVPRGSGGSSALRTGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGSGGGGSYIPEAPRDGQAYVRKDGEWVLLSTFLGGLVPRGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1266 - protein, 536 aa, Artificial sequence
  modified RSV protein
MPMGSLQPLATLYLLGMLVASVLAAEHHHHHHHHSAWSHPQFEKGGLVPRGSGGSSALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGSGGGGSYIPEAPRDGQAYVRKDGEWVLLSTFLGGLVPRGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1267 - protein, 523 aa, Artificial sequence
  modified RSV protein
MPMGSLQPLATLYLLGMLVASVLAAEHHHHHHHHSAWSHPQFEKGGLVPRGSGGSGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGSYIPEAPRDGQAYVRKDGEWVLLSTFLGGLVPRGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1268 - protein, 526 aa, Artificial sequence
  modified RSV protein
MPMGSLQPLATLYLLGMLVASVLAAEHHHHHHHHSAWSHPQFEKGGLVPRGSGGSGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGSYIPEAPRDGQAYVRKDGEWVLLSTFLGGLVPRGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1269 - protein, 287 aa, Artificial sequence
  modified RSV protein
MDSKGSSQKGSRLLLLLVVSNLLLPQGVVGQGHHHHHHGLEVLFQGPLDLKNFIDKQLLPIMNKQSCSISNIELVIEFQQMNNRPGGELSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1270 - protein, 287 aa, Artificial sequence
  modified RSV protein
MDSKGSSQKGSRLLLLLVVSNLLLPQGVVGQGHHHHHHGLEVLFQGPLDLCNFIDKQLLPIMNKQSCSISNIELVIEFQQMNNRPGGCLSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1271 - protein, 287 aa, Artificial sequence
  modified RSV protein
MDSKGSSQKGSRLLLLLVVSNLLLPQGVVGQGHHHHHHGLEVLFQGPLCLKNFIDKQLLPIMNKQSCSISNIELVIEFQQMNNRPGGCLSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1272 - protein, 287 aa, Artificial sequence
  modified RSV protein
MDSKGSSQKGSRLLLLLVVSNLLLPQGVVGQGHHHHHHGLEVLFQGPLDLKNFIDKQLLPIMNKQSCSISNIELVIEFQQMNNRGSGELSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1273 - protein, 287 aa, Artificial sequence
  modified RSV protein
MDSKGSSQKGSRLLLLLVVSNLLLPQGVVGQGHHHHHHGLEVLFQGPLDLCNFIDKQLLPIMNKQSCSISNIELVIEFQQMNNRGSGCLSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1274 - protein, 287 aa, Artificial sequence
  modified RSV protein
MDSKGSSQKGSRLLLLLVVSNLLLPQGVVGQGHHHHHHGLEVLFQGPLCLKNFIDKQLLPIMNKQSCSISNIELVIEFQQMNNRGSGCLSNIKENKCNGTDAKVKLIKQELDKYKNAVAELQDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1275 - protein, 256 aa, Artificial sequence
  modified RSV protein
MPMGSLQPLATLYLLGMLVASVLAQQSAWSHPQFEKHHHHHHGLVPRGSSGGNIKENKCPHCDKKFNDKQNLKQHNKQHQADGSGSGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1276 - protein, 256 aa, Artificial sequence; identical to SEQ ID NO: 1275
  modified RSV protein

SEQ ID NO: 1277 - protein, 309 aa, Artificial sequence
  modified RSV protein
MRPTWAWWLFLVLLLALWAPARGSAWSHPQFEKHHHHHHHHLVPRGSNVSFERTIELLRNNKQQFEIVTEINSISCSQKNLIPLLQKDIYNKLDLVKFTGGVITIELSNIKENKCNGTDAKVKLIKQELDKYKNAVTELQLLMGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1278 - protein, 311 aa, Artificial sequence
  modified RSV protein
MRPTWAWWLFLVLLLALWAPARGSAWSHPQFEKHHHHHHHHLVPRGSNVSFERTIELLRNNKQQFEIVTEINSISCSQKNLIPLLQKDIYNKLDLVKFTGGVITIELSNIKENKCNGTDAKVKLIKQELDKYKNAVTELQLLMGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1279 - protein, 242 aa, Artificial sequence
  modified RSV protein
MPMGSLQPLATLYLLGMLVASVLASNIKENKCPHCDKKFNDKQNLKQHNKQHQADGSGSGSGGGSQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLRSGLVPRGSHHHHHHSAWSHPQFEK

SEQ ID NO: 1280 - protein, 254 aa, Artificial sequence
  modified RSV protein
MPMGSLQPLATLYLLGMLVASVLAQSNAMAVDMFIKIGDVKGESKDKTHAEEIDVLAWSWGMSQSGSMHMGGGGGAGKVNVQDLSFTKYIDKSTPNLMMACSSGKHYPQAKLTIRKACGENQVEYLIITLKEVLVSSVSTGGSGGEDRLTENVTLNFAQVQVDYQPQKADGAKDGGPVKYGWNICQNVQAGSGSGSNIKENKCPHCDKKFNDKQNLKQHNKQHQADGGGGSGLVPRGSHHHHHHSAWSHPQFEK

SEQ ID NO: 1281 - protein, 437 aa, Artificial sequence
  modified RSV protein
MPMGSLQPLATLYLLGMLVASVLAQQSAWSHPQFEKSHHHHHHLVPRGSGGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKENKCNGTDAKVKQIKQELDKYKNAVTELQQLMQSTPCTNGGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1282 - protein, 436 aa, Artificial sequence
  modified RSV protein
MPMGSLQPLATLYLLGMLVASVLAQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLRGGSGGSGGSGGSGGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKENKCNGTDAKVKQIKQELDKYKNAVTELQQLMQSTPCTNGGAGGGLVPRGSHHHHHHSAWSHPQFEK

SEQ ID NO: 1283 - protein, 441 aa, Artificial sequence
  modified RSV protein
MPMGSLQPLATLYLLGMLVASVLAQSNAMAVDMFIKIGDVKGESKDKTHAEEIDVLAWSWGMSQSGSMHMGGGGGAGKVNVQDLSFTKYIDKSTPNLMMACSSGKHYPQAKLTIRKACGENQVEYLIITLKEVLVSSVSTGGSGGEDRLTENVTLNFAQVQVDYQPQKADGAKDGGPVKYGWNICQNVQAGSGSGSSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGWYTSVITIELSNIKENKCNGTDAKVKQIKQELDKYKNAVTELQQLMQSTPCTNGGAGGGLVPRGSHHHHHHSAWSHPQFEK

SEQ ID NO: 1284 - protein, 440 aa, Artificial sequence
  modified RSV protein
MPMGSLQPLATLYLLGMLVASVLAQSNAMAVDMFIKIGDVKGESKDKTHAEEIDVLAWSWGMSQSGSMHMGGGGGAGKVNVQDLSFTKYIDKSTPNLMMACSSGKHYPQAKLTIRKACGENQVEYLIITLKEVLVSSVSTGGSGGEDRLTENVTLNFAQVQVDYQPQKADGAKDGGPVKYGWNICQNVQAGSGSGSGWYTSVITIELSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELLSLINDMPITNDQKKLMSNNVQIVRQQSYSIMCIIKEEVLAYVVQLPLYGGGLVPRGSHHHHHHSAWSHPQFEK

SEQ ID NO: 1285 - protein, 441 aa, Artificial sequence
  modified RSV protein
MPMGSLQPLATLYLLGMLVASVLAQSNAMAVDMFIKIGDVKGESKDKTHAEEIDVLAWSWGMSQSGSMHMGGGGGAGKVNVQDLSFTKYIDKSTPNLMMACSSGKHYPQAKLTIRKACGENQVEYLIITLKEVLVSSVSTGGSGGEDRLTENVTLNFAQVQVDYQPQKADGAKDGGPVKYGWNICQNVQAGSGSGSSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGWYTSVITIELSNIKENKCNGTDAKVKQIKQELDKYKNAVTELQQLMQSTPCTNGGAGGGLVPRGSHHHHHHSAWSHPQFEK

SEQ ID NO: 1286 - protein, 440 aa, Artificial sequence
  modified RSV protein
MPMGSLQPLATLYLLGMLVASVLAQSNAMAVDMFIKIGDVKGESKDKTHAEEIDVLAWSWGMSQSGSMHMGGGGGAGKVNVQDLSFTKYIDKSTPNLMMACSSGKHYPQAKLTIRKACGENQVEYLIITLKEVLVSSVSTGGSGGEDRLTENVTLNFAQVQVDYQPQKADGAKDGGPVKYGWNICQNVQAGSGSGSGWYTSVITIELSNIKENKCNGTDAKVKQIKQELDKYKNAVTELQQLMQSTPCTNGGAGSAIASGVAVCKVLHLEGEVNKIKSSLLSTNKSQVSLSNGVSVLTFKVLDLKNYIDKQLLPILNKQSCSISNQETVQEFQQKNNRLLEITREFSQNCGVTTPVSTYMLTNSELKSLINDMPITNDQKKKMSNNVQQVRQQSYSIMCIIKEEVLAYVVQLPLYGGGLVPRGSHHHHHHSAWSHPQFEK

SEQ ID NO: 1287 - protein, 305 aa, Artificial sequence
  modified RSV protein
MDSKGSSQKGSRLLLLLVVSNLLLPQGVVGQSAWSHPQFEKHHHHHHHHLVPRGSGDLDLKNFIDKQLLPIMNKQSCSISNIELVIEFQQMNNRLLEAPGGELSNIKENKCNGTDAKVKLIKQELDKYKNAVAELQGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1288 - protein, 304 aa, Artificial sequence
  modified RSV protein
MDSKGSSQKGSRLLLLLVVSNLLLPQGVVGSAWSHPQFEKHHHHHHHHLVPRGSGDLDLCNFIDKQLLPIMNKQSCSISNIELVIEFQQMNNRLLEAPGGCLSNIKENKCNGTDAKVKLIKQELDKYKNAVAELQGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1289 - protein, 304 aa, Artificial sequence
  modified RSV protein
MDSKGSSQKGSRLLLLLVVSNLLLPQGVVGSAWSHPQFEKHHHHHHHHLVPRGSGDLDLCNFIDKQLLPIMNKQSCSISNIELVIEFQQMNNRLLEAGSGCLSNIKENKCNGTDAKVKLIKQELDKYKNAVAELQGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1290 - protein, 300 aa, Artificial sequence
  modified RSV protein
MDSKGSSQKGSRLLLLLVVSNLLLPQGVVGSAWSHPQFEKHHHHHHHHLVPRGSGDLDLKNFIDKQLLPIMNKQSCSISNIELVIEFQQMNNRGSGELSNIKENKCNGTDAKVKLIKQELDKYKNAVAELQGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1291 - protein, 300 aa, Artificial sequence
  modified RSV protein
MDSKGSSQKGSRLLLLLVVSNLLLPQGVVGSAWSHPQFEKHHHHHHHHLVPRGSGDLDLCNFIDKQLLPIMNKQSCSISNIELVIEFQQMNNRGSGCLSNIKENKCNGTDAKVKLIKQELDKYKNAVAELQGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1292 - protein, 433 aa, Artificial sequence
  modified RSV protein
MDSKGSSQKGSRLLLLLVVSNLLLPQGVVGQSAWSHPQFEKHHHHHHHHGLVPRGSYTSVITIELSNIKENKCNGTDAKVKLIKQELDKYKNAVTELQLLGSGGGSGASGVAVCKVLHLEGEVNKIKSALLSTNKAVVSLSNGVSVLTFKVLDLKNFIDKQLLPIMNKQSCSISNIELVIEFQQMNNRLLEITREFSVNAGVTTPVSTYMLTNSELLSLINDMPITNDQKKLMSNNVQIVRQQSYSIMCIIKEEVLAYVVQLPGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1293 - protein, 317 aa, Artificial sequence
  modified RSV protein
MDSKGSSQKGSRLLLLLVVSNLLLPQGVVGQSAWSHPQFEKHHHHHHGLVPRGSNLDLCNYIDKQLLPILNKQSCSISNIETVIEFFFKNLRLLWICWESSVNAGGGSGSGGCLSNIKENKCNGTDAKVKLIKQELDKYKNCVTELQLLKGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1294 - protein, 317 aa, Artificial sequence
  modified RSV protein
MDSKGSSQKGSRLLLLLVVSNLLLPQGVVGQSAWSHPQFEKHHHHHHGLVPRGSKLDLCNYIDKQLLPIVNKQSCSISNIETVIEFQQKNNRLLEICRESSVNAGGGSGSGGCLSNIKENKCNGTDAKVKLIKQEFDKYKNCVTELQLRKGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1295 - protein, 317 aa, Artificial sequence
  modified RSV protein
MDSKGSSQKGSRLLLLLVVSNLLLPQGVVGQSAWSHPQFEKHHHHHHGLVPRGSVLWLCNYIDKQLLPILNKQSCSISNIETVIEFQQKNNRLLEICREFSVNAGGGSGSGGCLSNIKENKCNGTDAKVKLIKQELDKYKNCVTELQLLMGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1296 - protein, 316 aa, Artificial sequence
  modified RSV protein
MDSKGSSQKGSRLLLLLVVSNLLLPQGVVGQSAWSHPQFEKHHHHHHGLVPRGSVLWLCNYIDKQLLPIVNKQSCSISNIETVIEFQQKNNRLLWICWEFSVNAGGGSGSGGCLSNIKENKCNGTDAKVKLIKQEFDKYKNCVTELQLLMGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1297 - protein, 437 aa, Artificial sequence
  modified RSV protein
MDSKGSSQKGSRLLLLLVVSNLLLPQGVVGHHHHHHSAWSHPQFEKGGLVPRGSQNDLCNYIDKQLLPQVNKQSCSISNQETVQEFQQKNNRFLEITREASVNSGPAVIITQHMPPGFTRSFAERANKLCGASVKEAEDGERVLPGHAYIAPGDKHMELARSGANYQIKIHDGPPVNRHRPSVDVLFHSVAKHAGRNAVGVIGTGMGNDGAAGMLAMSQAGAGCASNIKENKCNGTDAKVKLIKQEFDKYKNAVTELQLGGSGGSGGSGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1298 - protein, 304 aa, Artificial sequence
  modified RSV protein
MRPTWAWWLFLVLLLALWAPARGSAWSHPQFEKHHHHHHHHGLVPRGSGQELSNIKENKCNGTDAKVKSIKQELDKYKNAVTELQGGSGGLDLKNYIDKQLLPIVNKQSCSISNSETVSEFQQKNNRLLEITREFSGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1299 - protein, 318 aa, Artificial sequence
  modified RSV protein
MRPTWAWWLFLVLLLALWAPARGSAWSHPQFEKHHHHHHHHGLVPRGSGQELSNIKENKCNGTDAKGGNAERAKNVNGLLQVLMDINTLNGGSGGSGLDLKNYIDKQLLPIVNKQSCSISNIEGGKSSSKKEYMDSMNEKVAVMRNTGGSGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1300 - protein, 310 aa, Artificial sequence
  modified RSV protein
MRPTWAWWLFLVLLLALWAPARGSAWSHPQFEKHHHHHHHHGLVPRGSGQLDLKNYIDKQLLPIVNKQSCGSGDAKVKLIKQELDKYKNAVTELQGGSGGELSNIKENKCNGTGSGSISNIETVIEFQQKNNRLLEITREFSGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1301 - protein, 310 aa, Artificial sequence
  modified RSV protein
MRPTWAWWLFLVLLLALWAPARGSAWSHPQFEKHHHHHHHHGLVPRGSGQLDLKNYIDKQLLPIVNKQSCGSGDAKVKQIKQELDKYKNAVTELQGGSGGELSNIKENKCNGTGSGSISNQETVNEFQQKNNRLLEITREFSGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1302 - protein, 497 aa, Artificial sequence
  modified RSV protein
MPMGSLQPLATLYLLGMLVASVLAAEGSHHHHHHHHSAWSHPQFEKGGLVPRGSESALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1303 - protein, 484 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1304 - protein, 487 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1305 - protein, 764 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1306 - protein, 746 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1307 - protein, 752 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1308 - protein, 791 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGYIPEAPRDGQAYVRKDGEWVLLSTFLGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1309 - protein, 779 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGYIPEAPRDGQAYVRKDGEWVLLSTFLGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1310 - protein, 513 aa, Artificial sequence
  modified RSV protein
MPMGSLQPLATLYLLGMLVASVLAAEGSHHHHHHHHSAWSHPQFEKGGLVPRGSEAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGYIPEAPRDGQAYVRKDGEWVLLSTFLGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1311 - protein, 769 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGSGGGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1312 - protein, 751 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1313 - protein, 757 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1314 - protein, 419 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1315 - protein, 460 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1316 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1317 - protein, 419 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1318 - protein, 421 aa, Artificial sequence
  modified RSV protein
QQSAWSHPQFEKHHHHHHHHGLEVLFQGPGQSAIASGTAVCKVLHKEGEVNKIKSSLLSTNKSQVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQQLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1319 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNQETVQEFQQKNNRLLEITREFSSNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1320 - protein, 419 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1321 - protein, 419 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNQETVQEFQQKNNRLLEITREFSSNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1322 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNQETVQEFQQKNNRLLEITREFSSNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1323 - protein, 422 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1324 - protein, 424 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1325 - protein, 419 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1326 - protein, 311 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 1327 - protein, 297 aa, Artificial sequence
  modified RSV protein
MDSKGSSQKGSRLLLLLVVSNLLLPQGVVGQDLDLKNFIDKQLLPIMNKQSCSISNIELVIEFQQMNNRLLEAPGGELSNIKENKCNGTDAKVKLIKQELDKYKNAVAELQGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1328 - protein, 297 aa, Artificial sequence
  modified RSV protein
MDSKGSSQKGSRLLLLLVVSNLLLPQGVVGQDLDLCNFIDKQLLPIMNKQSCSISNIELVIEFQQMNNRLLEAPGGCLSNIKENKCNGTDAKVKLIKQELDKYKNAVAELQGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1329 - protein, 297 aa, Artificial sequence
  modified RSV protein
MDSKGSSQKGSRLLLLLVVSNLLLPQGVVGQDLDLCNFIDKQLLPIMNKQSCSISNIELVIEFQQMNNRLLEAGSGCLSNIKENKCNGTDAKVKLIKQELDKYKNAVAELQGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1330 - protein, 293 aa, Artificial sequence
  modified RSV protein
MDSKGSSQKGSRLLLLLVVSNLLLPQGVVGQDLDLKNFIDKQLLPIMNKQSCSISNIELVIEFQQMNNRGSGELSNIKENKCNGTDAKVKLIKQELDKYKNAVAELQGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1331 - protein, 293 aa, Artificial sequence
  modified RSV protein
MDSKGSSQKGSRLLLLLVVSNLLLPQGVVGQDLDLCNFIDKQLLPIMNKQSCSISNIELVIEFQQMNNRGSGCLSNIKENKCNGTDAKVKLIKQELDKYKNAVAELQGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1332 - protein, 422 aa, Artificial sequence
  modified RSV protein
MDSKGSSQKGSRLLLLLVVSNLLLPQGVVGYTSVITIELSNIKENKCNGTDAKVKLIKQELDKYKNAVTELQLLGSGGGSGASGVAVCKVLHLEGEVNKIKSALLSTNKAVVSLSNGVSVLTFKVLDLKNFIDKQLLPIMNKQSCSISNIELVIEFQQMNNRLLEITREFSVNAGVTTPVSTYMLTNSELLSLINDMPITNDQKKLMSNNVQIVRQQSYSIMCIIKEEVLAYVVQLPGSGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRLVPRGSGSAWSHPQFEKHHHHHHHH

SEQ ID NO: 1333 - protein, 309 aa, Artificial sequence
  modified RSV protein
MDSKGSSQKGSRLLLLLVVSNLLLPQGVVGQSAWSHPQFEKHHHHHHGLVPRGSKLDLCNYIDKQLLPIVNKQSCSISNIETVIEFQQKNNRLLEICRESSVNAGGGSGSGGCLSNIKENKCNGTDAKVKLIKQEFDKYKNCVTELQLRKGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1334 - protein, 311 aa, Artificial sequence
  modified RSV protein
MDSKGSSQKGSRLLLLLVVSNLLLPQGVVGQSAWSHPQFEKHHHHHHGLVPRGSVLWLCNYIDKQLLPILNKQSCSISNIETVIEFQQKNNRLLEICREFSVNAGGGSGSGGCLSNIKENKCNGTDAKVKLIKQELDKYKNCVTELQLLMGGSGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1335 - protein, 310 aa, Artificial sequence
  modified RSV protein
MDSKGSSQKGSRLLLLLVVSNLLLPQGVVGQSAWSHPQFEKHHHHHHGLVPRGSVLWLCNYIDKQLLPIVNKQSCSISNIETVIEFQQKNNRLLWICWEFSVNAGGGSGSGGCLSNIKENKCNGTDAKVKLIKQEFDKYKNCVTELQLLMGGSGSGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1336 - protein, 428 aa, Artificial sequence
  modified RSV protein
MDSKGSSQKGSRLLLLLVVSNLLLPQGVVGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLRGGSGGSGGSGGSGGGQNDLCNYIDKQLLPQVNKQSCSISNQETVQEFQQKNNRFLEITREASVNSGPAVIITQHMPPGFTRSFAERANKLCGASVKEAEDGERVLPGHAYIAPGDKHMELARSGANYQIKIHDGPPVNRHRPSVDVLFHSVAKHAGRNAVGVIGTGMGNDGAAGMLAMSQAGAGCASNIKENKCNGTDAKVKLIKQEFDKYKNAVTELQLGGLVPRGSHHHHHHSAWSHPQFEK

SEQ ID NO: 1337 - protein, 297 aa, Artificial sequence
  modified RSV protein
MRPTWAWWLFLVLLLALWAPARGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGQELSNIKENKCNGTDAKVKSIKQELDKYKNAVTELQGGSGGLDLKNYIDKQLLPIVNKQSCSISNSETVSEFQQKNNRLLEITREFGLVPRGSGHHHHHHHHSAWSHPQFEK

SEQ ID NO: 1338 - protein, 309 aa, Artificial sequence
  modified RSV protein
MRPTWAWWLFLVLLLALWAPARGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGQELSNIKENKCNGTDAKGGNAERAKNVNGLLQVLMDINTLNGGSGGSGLDLKNYIDKQLLPIVNKQSCSISNIEGGKSSSKKEYMDSMNEKVAVMRNTGLVPRGSGHHHHHHHHSAWSHPQFEK

SEQ ID NO: 1339 - protein, 303 aa, Artificial sequence
  modified RSV protein
MRPTWAWWLFLVLLLALWAPARGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGQLDLKNYIDKQLLPIVNKQSCGSGDAKVKLIKQELDKYKNAVTELQGGSGGELSNIKENKCNGTGSGSISNIETVIEFQQKNNRLLEITREFGLVPRGSGHHHHHHHHSAWSHPQFEK

SEQ ID NO: 1340 - protein, 303 aa, Artificial sequence
  modified RSV protein
MRPTWAWWLFLVLLLALWAPARGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGQLDLKNYIDKQLLPIVNKQSCGSGDAKVKQIKQELDKYKNAVTELQGGSGGELSNIKENKCNGTGSGSISNQETVNEFQQKNNRLLEITREFGLVPRGSGHHHHHHHHSAWSHPQFEK

SEQ ID NO: 1341 - protein, 488 aa, Artificial sequence
  modified RSV protein
MPMGSLQPLATLYLLGMLVASVLAAEGSHHHHHHHHSAWSHPQFEKGGLVPRGSESALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1342 - protein, 475 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1343 - protein, 478 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1344 - protein, 755 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGSGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1345 - protein, 737 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1346 - protein, 743 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1347 - protein, 782 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGYIPEAPRDGQAYVRKDGEWVLLSTFLGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1348 - protein, 770 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGYIPEAPRDGQAYVRKDGEWVLLSTFLGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1349 - protein, 504 aa, Artificial sequence
  modified RSV protein
MPMGSLQPLATLYLLGMLVASVLAAEGSHHHHHHHHSAWSHPQFEKGGLVPRGSEAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTDAKVKLIKQELDKYKNAVTELQLLMQSTPATGGYIPEAPRDGQAYVRKDGEWVLLSTFLGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1350 - protein, 760 aa, Artificial sequence
  modified RSV protein
MPMGSLQPLATLYLLGMLVASVLAAEGSHHHHHHHHSAWSHPQFEKGGLVPRGSEALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGSGGGGALRTGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1351 - protein, 742 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1352 - protein, 748 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGSGGGGGWYTSVITIELSNIKENKCNGTDAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1353 - protein, 421 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1354 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1355 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1356 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1357 - protein, 421 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1358 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1359 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNQETVQEFQQKNNRLLEITREFSSNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1360 - protein, 421 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1361 - protein, 421 aa, Artificial sequence
  modified RSV protein
QQSAWSHPQFEKHHHHHHHHGLEVLFQGPGQSAIASGTAVCKVLHKEGEVNKIKSSLLSTNKSQVSLSNGTSVLTFKVLDLKNYIDKQLLPILNKQSCSISNQETVQEFQQKNNRLLEITREFSSNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKKIKQELDKYKNAVTELQQLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1362 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1363 - protein, 424 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1364 - protein, 424 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1365 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1366 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNQETVQEFQQKNNRLLEITREFSSNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1367 - protein, 421 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNQETVQEFQQKNNRLLEITREFSSNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKKIKQELDKYKNAVTELQLLMQSTPATNNGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1368 - protein, 304 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1369 - protein, 304 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSHHHHHHSAWSHPQFEK

SEQ ID NO: 1370 - protein, 331 aa, Artificial sequence
  modified RSV protein
MDSKGSSQKGSRLLLLLVVSNLLLPQGVVGSAWSHPQFEKHHHHHHHHLVPRGSGDLDLKNFIDKQLLPIMNKQSCSISNIELVIEFQCMNNRLLEAPGGELSNIKENKCNGTDAKVCLIKQELDKYKNAVRMKQIEDKIEEILSKIYHIENEIARIKKLIGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1371 - protein, 326 aa, Artificial sequence
  modified RSV protein
MDSKGSSQKGSRLLLLLVVSNLLLPQGVVGSAWSHPQFEKHHHHHHHHLVPRGSGDLDLKNFIDKQLLPIMNKQSCSISNIELVIEFQCMNNRGSGELSNIKENKCNGTDAKVCLIKQELDKYKNAVRMKQIEDKIEEILSKIYHIENEIARIKKLIGSGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1372 - protein, 317 aa, Artificial sequence
  modified RSV protein
MDSKGSSQKGSRLLLLLVVSNLLLPQGVVGQSAWSHPQFEKHHHHHHGLVPRGSKLDLCNYIDKQLLPILNKQSCSISNICTVIEFFFKNLRLLWICWESSVNAGGGSGSGGCLSNIKENKCNGTDCKVKLIKQELDKYKNCVTELQLRKGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1373 - protein, 317 aa, Artificial sequence
  modified RSV protein
MDSKGSSQKGSRLLLLLVVSNLLLPQGVVGQSAWSHPQFEKHHHHHHGLVPRGSNLDLCNYIDKQLLPILNKQSCSISNICTVIEFFFKNLRLLWICWESSVNAGGGSGSGGCLSNIKENKCNGTDCKVKLIKQELDKYKNCVTELQLLKGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1374 - protein, 374 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLMGGSGSGSGVLDLCNYIDKQLLPIVNKQSCSISNICTVIEFQQKNNRLLEICREFSVNGGGSSGVRLWATRQAMLGQVHEVPEGWLIFVAEQEELYVRVQNGFRKVQLEARTPLGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1375 - protein, 374 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQEFDKYKNCVTELQLLMGGSGSGSGVLDLCNYIDKQLLPIVNKQSCSISNICTVIEFQQKNNRLLEICREFSVNGGGSSGVRLWATRQAMLGQVHEVPEGWLIFVAEQEELYVRVQNGFRKVQLEARTPLGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1376 - protein, 378 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLMGGSGSGSGVLDLCNYIDKQLLPILNKQSCSISNICTLIEFQQKNNRLLEICREFSVNGGGSSGVRLWATRQAMLGQVHEVPEGWLIFVAEQEELYVRVQNGFRKVQLEARTPLPRGGSGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1377 - protein, 379 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLKNGSGSGSGNLSLCNYIDKQLLPILNKQSCSISNICTVIEFFFKNLRLLWICWERSVNGGGSSGVRLWATRQAMLGQVHEVPEGWLIFVAEQEELYVRVQNGFRKVQLEARTPLPRGGSGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1378 - protein, 319 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLKNGSGSGSGNLSLCNYIDKQLLPILNKQSCSISNICTVIEFFFKNLRLLWICWERSVNGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1379 - protein, 379 aa, Artificial sequence
  modified RSV protein
MDSKGSSQKGSRLLLLLVVSNLLLPQGVVGQSAWSHPQFEKHHHHHHGLVPRGSTICLSNIKENKCNGTDAKVKLIKQELDKYKNCVTELQLLKNGSGSGSGNLSLCNYIDKQLLPILNKQSCSISNIETVIEFFFKNLRLLWICWERSVNGGGSSGVRLWATRQAMLGQVHEVPEGWLIFVAEQEELYVRVQNGFRKVQLEARTPLPRGGSGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1380 - protein, 508 aa, Artificial sequence
  modified RSV protein
MYSMQLASCVTLTLVLLVNSQSAWSHPQFEKHHHHHHHHGSLVPRGSGSHMEEDPCECKSIVKFQTKVEELINTLQQKLEAVAKRIEALENKIIGGGSGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1381 - protein, 497 aa, Artificial sequence
  modified RSV protein
MYSMQLASCVTLTLVLLVNSQSAWSHPQFEKHHHHHHHHGSLVPRGSGSHMEEDPCECKSIVKFQTKVEELINTLQQKLEAVAKRIEALENKIISAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1382 - protein, 508 aa, Artificial sequence
  modified RSV protein
MYSMQLASCVTLTLVLLVNSSAWSHPQFEKHHHHHHHHGSLVPRGSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGGGSGGSGGIKEEIAKIKEEQAKIKEKIAEIEKRIAEIEKRIAGGCCGSGGGSSGSGGGSSGGGSSGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1383 - protein, 494 aa, Artificial sequence
  modified RSV protein
MYSMQLASCVTLTLVLLVNSQSAWSHPQFEKHHHHHHHHGSLVPRGSQGGSGGIKEEIAKIKEEQAKIKEKIAEIEKRIAEIEKRIAGGCCSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1384 - protein, 501 aa, Artificial sequence
  modified RSV protein
MYSMQLASCVTLTLVLLVNSQSAWSHPQFEKHHHHHHHHGSLVPRGSQGGSGGIKEEIAKIKEEQAKIKEKIAEIEKRIAEIEKRIAGGCCGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1385 - protein, 497 aa, Artificial sequence
  modified RSV protein
MPMGSLQPLATLYLLGMLVASVLAAEGSHHHHHHHHSAWSHPQFEKGGLVPRGSESALRTGWYTSVITIELSNIKENKCNGTCAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1386 - protein, 484 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTCAKVKLIKQELDKYKNAVTELQLLMQSTPATGGAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1387 - protein, 487 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTCAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1388 - protein, 752 aa, Artificial sequence
  modified RSV protein
MPMGSLQPLATLYLLGMLVASVLAAEGSHHHHHHHHSAWSHPQFEKGGLVPRGSEGWYTSVITIELSNIKENKCNGTCAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGSGGWYTSVITIELSNIKENKCNGTCAKVKLIKQELDKYKNAVTELQLLMQSTPATNGSGSAIASGVAVCKVLHLEGEVNKIKSALLSTNKAVVSLSNGVSVLTFKVLDLKNYIDKQLLPILNKQSCSISNICTVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSGGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1389 - protein, 460 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1390 - protein, 460 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1391 - protein, 460 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1392 - protein, 460 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1393 - protein, 463 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1394 - protein, 463 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1395 - protein, 457 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLDEFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1396 - protein, 460 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1397 - protein, 460 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1398 - protein, 647 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 1399 - protein, 651 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGGGSGDIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 1400 - protein, 320 aa, Artificial sequence
  modified RSV protein
MDSKGSSQKGSRLLLLLVVSNLLLPQGVVGQDLDLKNFIDKQLLPIMNKQSCSISNIELVIEFQCMNNRLLEAPGGELSNIKENKCNGTDAKVCLIKQELDKYKNAVRMKQIEDKIEEILSKIYHIENEIARIKKLIGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1401 - protein, 316 aa, Artificial sequence
  modified RSV protein
MDSKGSSQKGSRLLLLLVVSNLLLPQGVVGQDLDLKNFIDKQLLPIMNKQSCSISNIELVIEFQCMNNRGSGELSNIKENKCNGTDAKVCLIKQELDKYKNAVRMKQIEDKIEEILSKIYHIENEIARIKKLIGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSGSAWSHPQFEKHHHHHHHH

SEQ ID NO: 1402 - protein, 310 aa, Artificial sequence
  modified RSV protein
MDSKGSSQKGSRLLLLLVVSNLLLPQGVVGQSAWSHPQFEKHHHHHHGLVPRGSKLDLCNYIDKQLLPILNKQSCSISNICTVIEFFFKNLRLLWICWESSVNAGGGSGSGGCLSNIKENKCNGTDCKVKLIKQELDKYKNCVTELQLRKGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1403 - protein, 310 aa, Artificial sequence
  modified RSV protein
MDSKGSSQKGSRLLLLLVVSNLLLPQGVVGQSAWSHPQFEKHHHHHHGLVPRGSNLDLCNYIDKQLLPILNKQSCSISNICTVIEFFFKNLRLLWICWESSVNAGGGSGSGGCLSNIKENKCNGTDCKVKLIKQELDKYKNCVTELQLLKGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1404 - protein, 310 aa, Artificial sequence
  modified RSV protein
MDSKGSSQKGSRLLLLLVVSNLLLPQGVVGQSAWSHPQFEKHHHHHHGLVPRGSNLDLCNYIDKQLLPILNKQSCSISNIETVIEFFFKNLRLLWICWESSVNAGGGSGSGGCLSNIKENKCNGTDAKVKLIKQELDKYKNCVTELQLLKGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1405 - protein, 308 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLMGGSGSGSGVLDLCNYIDKQLLPIVNKQSCSISNICTVIEFQQKNNRLLEICREFSVNGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1406 - protein, 308 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQEFDKYKNCVTELQLLMGGSGSGSGVLDLCNYIDKQLLPIVNKQSCSISNICTVIEFQQKNNRLLEICREFSVNGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1407 - protein, 308 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLMGGSGSGSGVLDLCNYIDKQLLPILNKQSCSISNICTLIEFQQKNNRLLEICREFSVNGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1408 - protein, 308 aa, Artificial sequence
  modified RSV protein
MDSKGSSQKGSRLLLLLVVSNLLLPQGVVGQSAWSHPQFEKHHHHHHGLVPRGSTICLSNIKENKCNGTDCKVKLIKQELDKYKNCVTELQLLKNGSGSGSGNLSLCNYIDKQLLPILNKQSCSISNICTVIEFFFKNLRLLWICWERSVNGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1409 - protein, 314 aa, Artificial sequence
  modified RSV protein
MDSKGSSQKGSRLLLLLVVSNLLLPQGVVGQSAWSHPQFEKHHHHHHGLVPRGSTICLSNIKENKCNGTDAKVKLIKQELDKYKNCVTELQLLKNGSGSGSGNLSLCNYIDKQLLPILNKQSCSISNIETVIEFFFKNLRLLWICWERSVNGGSGSGGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 1410 - protein, 499 aa, Artificial sequence
  modified RSV protein
MYSMQLASCVTLTLVLLVNSQSAWSHPQFEKHHHHHHHHGSLVPRGSGSHMEEDPCECKSIVKFQTKVEELINTLQQKLEAVAKRIEALENKIIGGGSGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1411 - protein, 488 aa, Artificial sequence
  modified RSV protein
MYSMQLASCVTLTLVLLVNSQSAWSHPQFEKHHHHHHHHGSLVPRGSGSHMEEDPCECKSIVKFQTKVEELINTLQQKLEAVAKRIEALENKIISAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1412 - protein, 499 aa, Artificial sequence
  modified RSV protein
MYSMQLASCVTLTLVLLVNSSAWSHPQFEKHHHHHHHHGSLVPRGSSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGGGSSGGGSGGSGGIKEEIAKIKEEQAKIKEKIAEIEKRIAEIEKRIAGGCCGSGGGSSGSGGGSSGGGSSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1413 - protein, 485 aa, Artificial sequence
  modified RSV protein
MYSMQLASCVTLTLVLLVNSQSAWSHPQFEKHHHHHHHHGSLVPRGSQGGSGGIKEEIAKIKEEQAKIKEKIAEIEKRIAEIEKRIAGGCCSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1414 - protein, 492 aa, Artificial sequence
  modified RSV protein
MYSMQLASCVTLTLVLLVNSQSAWSHPQFEKHHHHHHHHGSLVPRGSQGGSGGIKEEIAKIKEEQAKIKEKIAEIEKRIAEIEKRIAGGCCGFLLGVGSAIASGVAVCKVLHLEGEVNKIKSALLSTNKAVVSLSNGVSVLTFKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGPGGWYTSVITIELSNIKENKCNGTDAKVKLIKQELDKYKNAVTELQLLMQSTPATNGGGSSGSGGGSSGGGSSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1415 - protein, 455 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1416 - protein, 455 aa, Artificial sequence
  modified RSV protein
QQSAWSHPQFEKHHHHHHHHGLEVLFQGPGQSAIASGVAVCKVLHLEGEVNKIKSALLSTNKAVVSLSNGVSVLTFKVLDLKNYIDKQLLPILNKQSCSISNIETVIEFQQKNNRLLEITREFSVNCGVTTPVSTYMLTNSELLSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1417 - protein, 455 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNAGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1418 - protein, 455 aa, Artificial sequence
  modified RSV protein
QQSAWSHPQFEKHHHHHHHHGLEVLFQGPGQSAIASGTAVCKVLHKEGEVNKIKSALLSTNKATVSLSNGTSVLTFKVLDLKNYIDKQLLPILNKQSCSISNIETVIEFQQKNNRLLEITREFSVNCGVTTPVSTYMLTNSELKSLINDMPITNDQKKKMSNNVQQVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1419 - protein, 452 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLDEFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1420 - protein, 455 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1421 - protein, 458 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1422 - protein, 458 aa, Artificial sequence
  modified RSV protein
QQSAWSHPQFEKHHHHHHHHGLEVLFQGPGQSCAIASGVAVCKVLHKEGEVNKIKSALLSTNKATVSLSNGVSVLTFKVLDLKNYIDKQLLPILNKQSCSISNIETVIEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNGCQGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1423 - protein, 455 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNAGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1424 - protein, 455 aa, Artificial sequence
  modified RSV protein
QQSAWSHPQFEKHHHHHHHHGLEVLFQGPGQSAIASGVAVCKVLHKEGEVNKIKSALLSTNKATVSLSNGVSVLTFKVLDLKNYIDKQLLPILNKQSCSISNIETVFEFQQKNNRLLEITREFSVNCGVTTPVSTYMLTNSELKSLINDMPITNDQKKLMSNNVQIVRQQSYSIMCIIKEEVLAYVVQLPLYGGSGGTGWYTSVITIELSNIKENKCNGTDAKVKLIKQELDKYKNAVTELQLLMQSTPATNNGGSGGSGGYIPEAPRDGQAYVRKDGEWVLLSTFLGAGGGSGGSGGSGGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSL

SEQ ID NO: 1425 - protein, 636 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1426 - protein, 640 aa, Artificial sequence
  modified RSV protein
MELLILKANAITTILTAVTFCFASGSAWSHPQFEKHHHHHHGLVPRGSELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 1427 - protein, 636 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSHHHHHHSAWSHPQFEK

SEQ ID NO: 1428 - protein, 640 aa, Artificial sequence
  modified RSV protein
MELLILKANAITTILTAVTFCFASGELSNIKENKCNGTDAKVKLIKQELDKYKNAVTELQLLMGGSGGGSGGGDLKNYIDKQLLPIVNKQSCSISNIETVIEFQQKNNRLLEITREFSVGGSGGGSGANPLYQKHIISINDLSRDDLNLVLATAAKLKANPQPELLKHKVIASAFFEASTRTRLSFETSMHRLGASVVGFSDSANTSLGKKGETLADTISVISTYVDAIVMAHPQEGAARLATEFSGNVPVLNAGDGSNQHPTQTLLDLFTIQETQGRLDNLHVAMVGDLKYGRTVHSLTQALAKFDGNRFYFIAPDALAMPQYILDMLDEKGIAWSLHSSIEEVMAEVDILYMTRVQKERLDPSEYANVKAQFVLRASDLHNAKANMKVLHPLPRVDEIATDVDKTPHAWYFQQAGNGIFARQALLALVLNRDLVLSGLVPRGGSGGGSGGGSGGGSGGGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGLVPRGSHHHHHHSAWSHPQFEK

SEQ ID NO: 1429 - protein, 665 aa, Artificial sequence
  modified RSV protein
QSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1430 - protein, 663 aa, Artificial sequence
  modified RSV protein
QSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1431 - protein, 665 aa, Artificial sequence
  modified RSV protein
QSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATGSGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1432 - protein, 689 aa, Artificial sequence
  modified RSV protein
MPMGSLQPLATLYLLGMLVASVLAQSAWSHPQFEKHHHHHHGGLVPRGSGGQNITEEFYQSTCSAVSKGYLSALRTGWYTSVITIELSNIKENKCNGTDAKVKLIKQELDKYKNAVTELQLLMQSTPATNNGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKSGS

SEQ ID NO: 1433 - protein, 527 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLARLLGSGSGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1434 - protein, 526 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLARLLGGSGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1435 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLARLLGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1436 - protein, 524 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLARLLGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1437 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1438 - protein, 525 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLAQSTGGSGIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHSAWSHPQFEK

SEQ ID NO: 1439 - protein, 688 aa, Artificial sequence
  modified RSV protein
MELLIHRSSAIFLTLAVNALYLTSSQQQSAWSHPQFEKHHHHHHGGLVPRGSGGQNITEEFYQSTCSAVSRGYFSALRTGWYTSVITIELSNIKETKCNGTDTKVKLIKQELDKYKNAVTELQLLMQNTPAAGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1440 - protein, 690 aa, Artificial sequence
  modified RSV protein
MELLIHRSSAIFLTLAVNALYLTSSQQQSAWSHPQFEKHHHHHHGGLVPRGSGGQNITEEFYQSTCSAVSRGYFSALRTGWYTSVITIELSNIKETKCNGTDTKVKLIKQELDKYKNAVTELQLLMQNTPAAGSGSAIASGIAVCKVLHLEGEVNKIKNALLSTNKAVVSLSNGVSVLTFKVLDLKNYINNRLLPILNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLGGSGGGGSGGSGESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 1441 - protein, 688 aa, Artificial sequence; identical to SEQ ID NO: 1439
  modified RSV protein

SEQ ID NO: 1442 - protein, 690 aa, Artificial sequence; identical to SEQ ID NO: 1440
  modified RSV protein

SEQ ID NO: 1443 - protein, 4 aa, Artificial sequence
  peptide linker
GGSG

SEQ ID NO: 1444 - protein, 6 aa, Artificial sequence
  peptide linker
GGSGGS

SEQ ID NO: 1445 - protein, 7 aa, Artificial sequence
  peptide linker
GGSGGSG

SEQ ID NO: 1446 - protein, 7 aa, Artificial sequence
  peptide linker
GGSGSGG

SEQ ID NO: 1447 - protein, 12 aa, Artificial sequence
  peptide linker
GGSGGGGSGGSG

SEQ ID NO: 1448 - protein, 5 aa, Artificial sequence
  peptide linker
GGSGG

SEQ ID NO: 1449 - protein, 8 aa, Artificial sequence
  peptide linker
GGSGSGSG

SEQ ID NO: 1450 - protein, 7 aa, Artificial sequence
  peptide linker
GSGGGSG

SEQ ID NO: 1451 - protein, 5 aa, Artificial sequence
  peptide linker
GGPGG

SEQ ID NO: 1452 - protein, 15 aa, Artificial sequence
  peptide linker
GGGSGGGSGGGSGGG

SEQ ID NO: 1453 - protein, 11 aa, Artificial sequence
  peptide linker
GGGSGGGSGGG

SEQ ID NO: 1454 - protein, 4 aa, Artificial sequence
  peptide linker
APGG

SEQ ID NO: 1455 - protein, 4 aa, Artificial sequence
  peptide linker
AGSG

SEQ ID NO: 1456 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLNAIVSTLNHEVTTLARIVGGLVPRGSHHHHHHSAWSHPQFEK

SEQ ID NO: 1457 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLEKIVSTLEHEVTTLERIVGGLVPRGSHHHHHHSAWSHPQFEK

SEQ ID NO: 1458 - protein, 558 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLEKKVSTLEHEVTTLERKVGGLVPRGSHHHHHHSAWSHPQFEK

SEQ ID NO: 1459 - protein, 566 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDELLHNIEAKISTILSKITTIEAEIARIKSLIGGGLVPRGSHHHHHHSAWSHPQFEK

SEQ ID NO: 1460 - protein, 566 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLNAIVSTLNHEVTTLARIVARIKSLIGGGLVPRGSHHHHHHSAWSHPQFEK

SEQ ID NO: 1461 - protein, 566 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLEKIVSTLEHEVTTLERIVARIKSLIGGGLVPRGSHHHHHHSAWSHPQFEK

SEQ ID NO: 1462 - protein, 566 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEWDASISQVNEKINQSLAFIRKSDEIVHKLEKKVSTLEHEVTTLERKVARIKSLIGGGLVPRGSHHHHHHSAWSHPQFEK

SEQ ID NO: 1463 - protein, 584 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNGGKKRKRRGGSAIGGYIPEAPRDGQAYVRKDGEWVLLSTFLGGSGGTTIIIVIIVILLSLIAVGLLLYSK

SEQ ID NO: 1464 - protein, 584 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNGGKKRKRRGGSAIGGYIPEAPRDGQAYVRKDGEWVLLSTFLGGSGGTTIIIVIIVILLSLIAVGLLLYSK

SEQ ID NO: 1465 - protein, 623 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNGGKKRKRRGGSAIGGYIPEAPRDGQAYVRKDGEWVLLSTFLGGSGGTTIIIVIIVILLSLIAVGLLLYSK

SEQ ID NO: 1466 - protein, 623 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNGGKKRKRRGGSAIGGYIPEAPRDGQAYVRKDGEWVLLSTFLGGSGGTTIIIVIIVILLSLIAVGLLLYSK

SEQ ID NO: 1467 - protein, 588 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNGGKKRKRRGGGTTIIIVIIVILLSLIAVGLLLYSK

SEQ ID NO: 1468 - protein, 588 aa, Artificial sequence
  modified RSV protein
MELLILKANAITTILTAVTFCFASGQQSAWSHPQFEKHHHHHHHHGGLVPRGSGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNGGKKRKRRGGGTTIIIVIIVILLSLIAVGLLLYSK

SEQ ID NO: 1469 - protein, 530 aa, Artificial sequence
  modified RSV protein
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGLEVLFQGPHHHHHHHHSAWSHPQFEK

SEQ ID NO: 1470 - protein, 124 aa, Artificial sequence
  modified RSV protein
EVQLQQSGAELVKPGASVKLSCTASGFNIKDTFFHWVKQRPEQGLEWIGRIDPADGHTKYDPKFQGKATITADTSSNTAFLQLSSLTSVDTAVYYCATTITAVVPTPYNAMDYWGQGTSVTVSS

SEQ ID NO: 1471 - protein, 111 aa, Artificial sequence
  modified RSV protein
DIVLTQSPASLAVSLGQRTTISCRASESVDSFDNSFIHWYQQKPGQPPKLLIFLASSLESGVPARFSGSGSRTDFTLTIDPVEADDAATYYCQQSNEDPFTFGSGTKLEIK

SEQ ID NO: 1472 - protein, 124 aa, Artificial sequence
  modified antibody
EVQLVESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 1473 - protein, 110 aa, Artificial sequence
  modified antibody
QSVVTQPPSVSGAPGQRVTISCTGSSSNIGAGYDVHWYQQLPGTAPKLLIYDNNNRPSGVPDRFSASKSGTSASLAITGLQAEDEADYYCQSYDRSLSGVFGTGTKVTVL

SEQ ID NO: 1474 - protein, 485 aa, artificial sequence
  modified RSV protein
QNITEEFYQSTCSAVSKGYLSALRTGWYTSVITIELSNIKENKCNGTDAKVKLIKQELDKYKNAVTELQLLMTSVLHRFDTDAFSGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPR

SEQ ID NO: 1475 - protein, 486 aa, artificial sequence
  modified RSV protein
QNITEEFYQSTCSAVSKGYLSALRTGWYTSVITIELSNIKENKCNGTDAKVKLIKQELDKYKNAVTELQLLMTSVLWFGDTDAFASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPR

SEQ ID NO: 1476 - protein, 466 aa, artificial sequence
  modified RSV protein
QNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNAGKSTTNGGLVPR

SEQ ID NO: 1477 - protein, 466 aa, artificial sequence
  modified RSV protein
QNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNACCSTTNGGLVPR

SEQ ID NO: 1478 - protein, 466 aa, artificial sequence
  modified RSV protein
QNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDECCHNVNACCSTTNGGLVPR

SEQ ID NO: 1479 - protein, 568 aa, artificial sequence
  modified RSV protein
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHSAWSHPQFEK

We claim:

1. An isolated immunogen, comprising:
a recombinant RSV F protein stabilized in a prefusion conformation by a non-natural disulfide bond between cysteine substitutions at position 155 and 290, and a cavity filling F, L, W, Y, H, or M substitution at position 190, position 207, or positions 190 and 207.

2. The immunogen of claim 1, wherein the prefusion conformation of the recombinant RSV F protein or fragment thereof comprises an antigenic site Ø comprising residues 62-69 and 196-209 of a native RSV F protein sequence set forth as one of SEQ ID NOs: 1-184.

3. The immunogen of claim 1, wherein the immunogen specifically binds to a D25, a AM22, a 5C4, or a MPE8 prefusion-specific antibody.

4. The immunogen of claim 1, wherein the RSV F protein is a RSV A, RSV B, or bovine RSV F protein.

5. The immunogen of claim 1, wherein the recombinant RSV F protein or fragment thereof comprises a $F_1$ polypeptide and a $F_2$ polypeptide, and optionally does not comprise a pep27 polypeptide or portion thereof.

6. The immunogen of claim 5, wherein the C-terminal residue of the $F_2$ polypeptide and the N-terminal residue of the $F_1$ polypeptide, respectively, comprise RSV F positions 97 and 137; 97 and 145; 97 and 150; 102 and 144; 102 and 145; 102 and 146; 102 and 147; 103 and 144; 103 and 145; 103 and 146; 103 and 147; 104 and 144; 104 and 145; 104 and 146; 104 and 147; 105 and 144; 105 and 145; 105 and 146; 105 and 147; or 105 and 150.

7. The immunogen of claim 5, wherein the $F_2$ and $F_1$ polypeptides respectively comprise or consist of RSV F positions: 26-109 and 137-513; 26-107 and 137-513; 26-107 and 145-513; 26-105 and 137-513; 26-105 and 145-513; 26-103 and 145-513; 26-109 and 137-529; 26-107 and 137-529; 26-107 and 145-529; 26-105 and 137-529; 26-105 and 145-529; 26-103 and 145-529; 46-103 and 147-310; 46-104 and 146-310; 50-96 and 149-306; 51-103 and 146-307; 51-103 and 139-307; 50-105 and 146-306; or 53-97 and 148 to one of 305-320.

8. The immunogen of claim 5, wherein the $F_1$ and $F_2$ polypeptides comprise amino acid sequences at least 80% identical to the corresponding sequences of a native RSV F protein sequence set forth as any one of SEQ ID NOs: 1-184, wherein the RSV F protein is stabilized in the prefusion conformation by the non-natural disulfide bond between cysteine substitutions at position 155 and 290, and the cavity filling F, L, W, Y, H, or M substitution at position 190, position 207, or positions 190 and 207.

9. The immunogen of claim 5, wherein the recombinant RSV F protein is a single chain RSV F protein and the $F_2$ and $F_1$ polypeptides are linked by a heterologous peptide linker, or are directly linked.

10. The immunogen of claim 9, wherein
position 105 of the $F_2$ polypeptide is linked to position 145 of the $F_1$ polypeptide by a Gly-Ser linker; or
position 103 of the $F_2$ polypeptide is directly linked to position 145 of the $F_1$ polypeptide.

11. The immunogen of claim 9, wherein the heterologous peptide linker comprises the amino acid sequence set forth as one of SEQ ID NOs: 356-365 or 1443-1453, or is a G, S, GG, GS, SG, GGG, or GSG linker.

12. The immunogen of claim 1, wherein the recombinant RSV F protein comprises S155C, S290C, S190F, and V207L substitutions.

13. The immunogen of claim 1, wherein the recombinant RSV F protein comprises or consists of
(A) the amino acid sequence set forth as residues 26-109 and 137-513, respectively, or 26-103 and 145-513, respectively, or 26-105 and 145-513, respectively, of
(i) SEQ ID NO: 372 (DSCav1, subtype B), 373 (DSCav1, bovine), or an amino acid sequence at least 80% identical thereto that comprises S155C, S290C, S190F, and V207L substitutions; or
(ii) one of SEQ ID NOs: 374 (DS S190F, subtype A), 375 (DS, S190F, subtype B), or 376 (DS, S190F, bovine); or an amino acid sequence at least 80% identical thereto that comprises S155C, S290C, and S190F substitutions; or
(B) the amino acid sequence set forth as one of:
residues 26-476 of SEQ ID NO: 669 (BZGJ9 DS-Cav1);
residues 26-472 of SEQ ID NO: 706 (BZGJ9-9 DS-Cav1);
residues 26-474 of SEQ ID NO: 707 (BZGJ9-10 DS-Cav1); or
an amino acid sequence at least 80% identical thereto that comprises the S155C, S290C, S190F, and V207L substitutions.

14. The immunogen of claim 1, wherein the $F_1$ polypeptide comprises an RSV α10 helix comprising from RSV position 492 to one of positions 510-529, and wherein the α10 helix comprises at least two cysteine substitutions that form a non-natural inter-protomer disulfide bond.

15. The immunogen of claim 14, wherein positions 512-524 of the $F_1$ polypeptide comprise the amino acid sequence set forth as CCHNVNAGKSTTN (residues 512-524 of SEQ ID NO: 844) or CCHNVNACCSTTN (residues 512-524 of SEQ ID NO: 849); or wherein positions 512-529 of the $F_1$ polypeptide comprise the amino acid sequence set forth as CCHNVNACCSTTNICCTT (residues 512-529 of SEQ ID NO: 853).

16. The immunogen of claim 1, wherein the recombinant RSV F protein is linked to a scaffold protein.

17. The immunogen of claim 1, comprising a multimer of the recombinant RSV F protein or fragment thereof.

18. The immunogen of claim 1, wherein the recombinant RSV F protein or fragment thereof is linked to a trimerization domain.

19. The immunogen of claim 18, wherein the C-terminus of the $F_1$ polypeptide of the recombinant RSV F protein is linked to the trimerization domain; and
optionally further comprising a protease cleavage site between the $F_1$ polypeptide and the trimerization domain.

20. The immunogen of claim 18, wherein the trimerization domain is a Foldon domain.

21. The immunogen of claim 18, wherein the recombinant RSV F protein linked to the trimerization domain comprises or consists of the amino acid sequence set forth as residues 26-109 and 137-544, or residues 26-103 and 145-544, of one of:
SEQ ID NO: 372 (DSCav1, subtype B), or 373 (DSCav1, bovine), or an amino acid sequence at least 80% identical thereto that comprises S155C, S290C, S190F, and V207L substitutions;
SEQ ID NOs: 374 (DS S190F, subtype A), 375 (DS, S190F, subtype B), or 376 (DS, S190F, bovine); or
an amino acid sequence at least 80% identical thereto that comprises S155C, S290C, and S 190F substitutions.

22. The immunogen of claim 18, wherein the recombinant RSV F protein linked to the trimerization domain comprises or consists of the sequence of the recombinant RSV F protein linked to the trimerization domain set forth as SEQ ID NO: 669 (BZGJ9 DSCav1), SEQ ID NO: 706 (BZGJ9-9 DSCav1), or SEQ ID NO: 707 (BZGJ9-10 DSCav1); or an amino acid sequence at least 80% identical thereto.

23. The immunogen of claim 1, wherein the recombinant RSV F protein or fragment thereof is linked to a protein nanoparticle subunit.

24. The immunogen of claim 23, wherein the protein nanoparticle subunit comprises:
a ferritin nanoparticle subunit comprising the amino acid sequence set forth as residues 517-679 of SEQ ID NO: 350, or an amino acid sequence at least 80% identical thereto, and optionally includes a C31S, C31A or C31V substitution in the ferritin polypeptide;
a SOR subunit comprising the amino acid sequence set forth as residues 516-825 of SEQ ID NO: 344 or SEQ ID NO: 345, or an amino acid sequence at least 80% identical thereto;
a lumazine synthase subunit comprising the amino acid sequence set forth as residues 517-670 of SEQ ID NO: 346 or SEQ ID NO: 348, or residues 517-669 of SEQ ID NO: 347, or an amino acid sequence at least 80% identical thereto; or
a pyruvate dehydrogenase synthase subunit comprising the amino acid sequence set forth as residues 516-757 of SEQ ID NO: 349, or an amino acid sequence at least 80% identical thereto.

25. The immunogen of claim 23, wherein the protein nanoparticle subunit comprises a ferritin nanoparticle subunit and the recombinant RSV F protein linked to the ferritin nanoparticle subunit comprises or consists of:
the amino acid sequence set forth as residues 26-105 and 137-679 of any one of SEQ ID NOs: 377-382 (A, B, bovine-DSCav1, and DS S190F ferritin particles), or an amino acid sequence at least 80% identical thereto that comprises S155C, S290C, S190F, and V207L substitutions or S155C, S290C, and S190F substitutions; and wherein the recombinant RSV F protein linked to the ferritin nanoparticle subunit forms a ferritin nanoparticle that specifically binds to the prefusion-specific antibody.

26. The immunogen of claim 23, wherein the recombinant RSV F protein linked to the ferritin nanoparticle subunit comprises the amino acid sequence set forth as one of:
residues 28-664 of SEQ ID NO: 1429 (BZGJ9 DS-Cav1 Longlink Ferritin);
residues 28-663 of SEQ ID NO: 1430 (BZGJ9-9 DS-Cav1 Longlink Ferritin); or
residues 28-665 of SEQ ID NO: 1431 (BZGJ9-10 DS-Cav1 Longlink Ferritin); or
an amino acid sequence at least 80% identical thereto that comprises S155C, S290C, S190F, and V207L substitutions.

27. The immunogen of claim 1, wherein the immunogen forms a homogeneous population of immunogens when incubated in aqueous solution, wherein at least 70% of the immunogens incubated in the solution specifically bind to the prefusion-specific antibody after:
(a) incubation for one hour in 350 mM NaCl pH 7.0, at 50° C.;
(b) incubation for one hour in 350 mM NaCl pH 3.5, at 25° C.;
(c) incubation for one hour in 350 mM NaCl pH 10, at 25° C.;
(d) incubation for one hour in 10 mM osmolarity, pH 7.0, at 25° C.;
(e) incubation for one hour in 3000 mM osmolarity, pH 7.0, at 25° C.; or
(f) ten freeze-thaw cycles in 350 mM NaCl pH 7.0; or
(g) a combination of two or more of (a)-(f); wherein
the immunogen is incubated in the solution in the absence of the prefusion-specific antibody.

28. A virus-like particle comprising the immunogen of claim 1.

29. A protein nanoparticle comprising the immunogen of claim 1.

30. An immunogenic composition comprising an effective amount of the immunogen of claim 1; and a pharmaceutically acceptable carrier.

31. The immunogenic composition of claim 30, further comprising:
(a) an adjuvant;
(b) an adjuvant that promotes a Th1 immune response;
(c) an adjuvant comprising alum, an oil-in water composition, MF59, AS01, AS03, AS04, MPL, QS21, a CpG oligonucleotide, a TLR7 agonist, a TLR4 agonist, a TLR3 agonist, or a combination of two or more thereof; or
(d) two or more of (a)-(c).

32. The immunogenic composition of claim 30, comprising a mixture of recombinant RSV F proteins or fragments thereof based on RSV F protein subtype A and B.

33. A method for generating an immune response to RSV F in a subject, comprising administering to the subject an effective amount of the immunogenic composition of claim 30 to generate the immune response.

34. The method of claim 33, comprising a prime-boost administration of the immunogenic composition.

35. A method for detecting or isolating an RSV F binding antibody in a subject, comprising:
providing an effective amount of the immunogen of claim 1;
contacting a biological sample from the subject with the recombinant RSV F protein or the protein nanoparticle under conditions sufficient to form an immune complex between the recombinant RSV F protein or the protein nanoparticle and the RSV F binding antibody; and detecting the immune complex, thereby detecting or isolating the RSV F binding antibody in the subject.

36. The method of claim 33, wherein the subject is at risk of or has an RSV infection, a human RSV subtype A infection, a human RSV subtype B infection, or a bovine RSV infection.

37. The method of claim 33, wherein the subject is a human or a veterinary subject; less than one year old; more than 65 years old; pregnant; a female of child bearing age; a school age child; 2-5 years old; 6-12 months old; or less than six months old.

38. A kit comprising the immunogen of claim 1; and instructions for using the kit.

39. A recombinant RSV F protein stabilized in a prefusion conformation by:
a non-natural disulfide bond between cysteine residues introduced by S155C and S290C substitutions; and
a S190F cavity filling substitution and a V207L cavity filling substitution; and
wherein a C-terminal residue of an $F_1$ polypeptide on the recombinant RSV F protein is one of RSV F positions 513-529 and is linked to a foldon trimerization domain by a heterologous peptide linker.

40. The immunogen of claim 1, wherein the recombinant RSV F protein further comprises one or more additional amino acid substitutions.

41. The immunogen of claim 40, wherein the recombinant RSV F protein further comprises a non-natural disulfide bond between cysteine substitutions at positions 183 and 428 and a glycine insertion between positions 182/183.

42. The immunogen of claim 41, wherein the recombinant RSV F protein comprises S155C, S290C, N183C, N428C, S190F, and V207L substitutions.

43. The immunogen of claim 41, wherein the RSV F protein is a single-chain RSV F protein and wherein position 103 of an $F_2$ polypeptide of the RSV F protein is linked to position 145 of an $F_1$ polypeptide of the RSV F protein by a heterologous glycine-serine peptide linker.

44. The immunogen of claim 43, wherein the $F_2$ and $F_1$ polypeptides comprise RSV F positions 26-103 and 145-513, respectively.

45. The immunogen of claim 41, wherein a C-terminal residue of an $F_1$ polypeptide of the recombinant RSV F protein comprises one of RSV F positions 513-529 and is linked to a trimerization domain by a heterologous peptide linker.

46. The immunogen of claim 44, wherein the trimerization domain is a foldon domain.

47. The immunogen of claim 40, wherein the recombinant RSV F protein further comprises a second non-natural disulfide bond between cysteine substitutions at positions 149 and 458.

48. The immunogen of claim 47, wherein the recombinant RSV F protein comprises S155C, S290C, A149C, Y458C, S190F, and V207L substitutions.

49. The immunogen of claim 47, wherein the RSV F protein is a single-chain RSV F protein and wherein position 103 of an $F_2$ polypeptide of the RSV F protein is linked to position 145 of an $F_1$ polypeptide of the RSV F protein by a heterologous glycine-serine peptide linker.

50. The immunogen of claim 49, wherein the $F_2$ and $F_1$ polypeptides comprise RSV F positions 26-103 and 145-513, respectively.

51. The immunogen of claim 47, wherein a C-terminal residue of an $F_1$ polypeptide of the recombinant RSV F protein comprises one of RSV F positions 513-529 and is linked to a trimerization domain by a heterologous peptide linker.

52. The immunogen of claim 51, wherein the trimerization domain is a foldon domain.

53. The immunogen of claim 12, wherein the recombinant RSV F protein comprises the amino acid sequence set forth as residues 26-109 and 137-513, respectively, of SEQ ID NO: 371 (DS-Cav1, subtype A), or an amino acid sequence at least 80% identical thereto that comprises the S155C, S290C, S190F, and V207L substitutions.

54. The immunogen of claim 12, wherein the recombinant RSV F protein comprises the amino acid sequence set forth as residues 26-105 and 145-513, respectively, of SEQ ID NO: 371 (DS-Cav1, subtype A), or an amino acid sequence at least 80% identical thereto that comprises the S155C, S290C, S190F, and V207L substitutions.

55. The immunogen of claim 12, wherein the recombinant RSV F protein comprises the amino acid sequence set forth as residues 26-103 and 145-513, respectively, of SEQ ID NO: 371 (DS-Cav1, subtype A), or an amino acid sequence at least 80% identical thereto that comprises the S155C, S290C, S190F, and V207L substitutions.

56. The immunogen of claim 18, wherein the recombinant RSV F protein linked to the trimerization domain comprises of the amino acid sequence set forth as residues 26-109 and 137-544, respectively, of SEQ ID NO: 371 (DS-Cav1, subtype A), or an amino acid sequence at least 80% identical thereto that comprises the S155C, S290C, S190F, and V207L substitutions.

57. The immunogen of claim 18, wherein the recombinant RSV F protein linked to the trimerization domain comprises of the amino acid sequence set forth as residues 26-105 and 137-544, respectively, of SEQ ID NO: 371 (DS-Cav1, subtype A), or an amino acid sequence at least 80% identical thereto that comprises the S155C, S290C, S190F, and V207L substitutions.

58. The immunogen of claim 18, wherein the recombinant RSV F protein linked to the trimerization domain comprises of the amino acid sequence set forth as residues 26-103 and 145-544, respectively, of SEQ ID NO: 371 (DS-Cav1, subtype A), or an amino acid sequence at least 80% identical thereto that comprises the S155C, S290C, S190F, and V207L substitutions.

* * * * *